United States Patent 9,328,346 (POLYCOMB-ASSOCIATED NON-CODING RNAS) - sequence listing, part 162

SEQ ID NO: 193023 - RNA, 66701 nt, Homo sapiens
aacacuuaucccacuuuuuauuuuuuacaaaaacgugcucauuuaauagaaaugauugauuauauaaaauuguuuacacauguauaaaaacuaggaacacguauguagguaagcaaucaaaaucaugcuuucuguuagaaaaguuaacacuucugugaauagacuggaugacuuccuuuuaguuuggaugucugggucggacucacgagacgcugggguugggguguggugcuugacaucagccucuggcaaagcacuaauaaaaggaaccccaaagcugacuguguacacaaaugggcuuuccauaaguucauuacauuuccuuuuccaagucaggaaaacucaacagugguagcuacuguggucuguccuugaagauucugagcagugcaaauguaauauccugcaucaaucgucucaaagucuuccacuguaaugacacucugggagauucucguggugugucccaguccucuguggaucaaccuccaagugucuuggaucgucacaggccuuucauccuguuuaacgacacccacaaagacugaagcaagagggacaagcugcuauaaagagcucccacucacccaacacuguugagcguuccuuucagagagcaaagcacaugcuuauaaaagacuguuuaguaugcguagcucauaagcuguggaagcuucuacacuggaaucauuuuagguugcauuuuuuccaaacagcccuugaauuucauuacguuguuuggcacugucuuucugcccuuuucuucuguaagguuuuacuuaaucuaaaauguaugcuuuuagaacuccaaggaaguggaacugguauuaagcauaagcagggacaaaauuuuccacuggccccguucuucacauugcccacuuucuuuuccuagcuaagugguucuuaccuacagaacugaaagucaguagccugaaaaagcacccacuguauaaaugacuaagagcucccaauugcucagauuugagagagggagaaguaugauuaggccagugugccuuaggacucuagugggagaaaaguuguaccaaggauggguaagauaauguacuacaugacaggaccccuauuucuacaaagugcgauggucacuuuugagauguccacccaacuccagugauaagaacauaguauuuucugaauucauguaacagaacuaauauaucacuaagugaauaccuuuucucauaaaauaccaaauagcaauguggcggggaccucuauugaaaaucaucaauguccuguaaguaugaccaacacguuugauaaucaagugccugguaccaggaugccggaaaacacuauuccccagagacaguuauuuucuaccaaucacagcccauaggccagaaggaugucagcuacuuaaugugucuuguggaggccaaaucucuucuggcaacaaagggauuauuccgugcugggagcagagcuguuauuuuagcaagcagaacaugcacaagggcuaaauacgcugcaauugcuuuuaugagaagucuacuuuaaaauuaucucuggccucacagcaccuuuuuggcguggucuauguccacuugguggaugucugcucacagcagcuugccaugggcacagcuuguauagagaacacucuagccaagugaaacacaggaauagaaaggagcagcagaaagagcccuaugggcucucucaguccccaaggaagccauuucugacuuugucucacagagaucccuggagagggcuaccagagaaacugggaaaagaccacagggagaaggaaacuucuagcugaacuuuguaacaauuuugaccaaacacaguuuccuggacagaacucgggugagggggugaagcaggagugcagacacagcacagaaaccguggcagguaggagaugugaaaucugaaaacccuguuugcuuucuuauccaagaggcugguagccugggacaaguucucaacccugcucauccacugccuagaaacaaacucggugcuguuggcagggacagagggagugagaccggcccuuugggcuacgugggagcugggugaggccuguaacugcuggcuuucccccacuucccuggugaccugcaugacacagcagagcagccauaauccccugaggaacauaaccccauuggccugagaaccacaccgccagucccaacagcagccauagcaagacccgcccaaggagagugucugagcucagacacgccuagcccacccccaacuaauggucuuuuucuacccacccugguagccgaagacaaaggacauaaucucuugggagcucuaggguccugcccaccaccugauccucccuauacuacugcagcuaaugcugucuuuaaagugccaccuccuggcagaagaccaacacaaaacuagugcaauaaacgaaacuacaacuaaggacccucacagaguucauccauuucacuccccugccaccuccauuagagcagcugcuggcauccauggcugagagaccugagacaucaaaggacucuguacaggcaccacuaaguaccagcccagagcccaguaacucugcuggguggcuagauacagaagagaaauaacaaucacugcaguuuggcucucaggaagccacacacauaggggaagggggagagcacuguaucaagagagcaccccaugggacaaaagaauaugaagagcagcccuugagccccagaucuucccucuaccauagucuacccaaauaagaaggaaccaguaaaacaauucugguaguauuucaaaacaaguuucuuuaacaccccagaagaucacacuagcucaccagcaauuuauccaauccaaaaagaaaucccugaauugccagaaaaagaauucagaaggucaguuauuaagcuacucaaggaggcaucagagaaaggugaacuccaacuuaauuaaaucaaaaaagauacaggauaugaagggaaaaaucuucagugaaauagauagcaaaaauagaaaacaaucauaauuucuggaaaugaagaacacacuuagagaaaugcaaaauacauuggaaagucuuagcaauagaacugaacaaccagaagaaagaacuucagaacucgaacaucagauuuuuggauuaacccaaucgaacaaagacaaacaaaaaagaauuuaaaagaaugaacaaagccuccaagauguuugggauuauauuaaacaaacaaaccuaagaauaauugguguuccugaggaagaggagaaaucuaaaaguuugaaagacauauuugagggaguaaucaaagaaaacuucccuggccuugcuagagagcuacacaucugaauacaagaagcucaaagaacaccugagaaauucauugcaaaaagaucgucaccuaggcacagagucaucagguuaucuaaagcgaagaugaaggaaagaaucuuaagagcugugaggcaaaagcaccagauaacuuauaaaggaaaacaugucagauuaacagcagauuccucagcagaaacccuacaagcuagaagaaauugaggcccuaccuucagccuccuuaaacaaaagaaucaucaucuaagaauuuuguguacagcaaaacuaagcuucauaaaugaaggagagauacagucuuuuucagacaaacaaaugcugagaaaauucgccacuacaaacccagcacuguaagaaaugcuaaaaggagcacuaaauauugaaacaaauccuugaaauacaccaaaauagaaccuucuuaaagcauaaaucucauaggaccuauaaaacaaaaacacaauaaauaaauaaauaaauaaaaaccaagguauucgggcaacaaauagcaagaugaauagaauaguaccucacaucugaauacuaauguugaauguaaauggccuaaaugcuccauuuaaaagauucagaauggcagaauggguaagaagucaccaaccaaguaucugcuguuuugaagagacucaccuaacaaauaggacuaacauaaacuuaugguaaagggcugggaaaagauauuccaugcaaagggacaccaaagugagcaggaguagcuauucuuuuuguuuguuuuguuuuguuugagacagagucucacucugucggccagacuggagugcaauggcucaaucuuggcucaaugcaaccuccaccucccagguucaagugauucuugugccucagccuccuuaguagcugggauuacaggugcaggccugucuuauagaggaguagcuguucuuauaucagacagaacaaacguuaaagaaacagcaguuaaaaaagagaaagacggacauuauguaaugauaaaaggacuugcccaacaggaaaauaucacaauuauauauauauauauauauauauauauauauauauauauauauauauaugcaccuaaugccagagcucccaaauuuauaaaacaauuacuguuacaccuaagaaaugagauagacugcaacacaguaauaguggggaacuucaauacuccacugucagcaauagauagguaaucaagacagaacaucaacaaagaaacaauggauuuaaacuauaaccuagaacaaauggacuuaagggcuauuuguagaacauucgacccaacaacugcagaauauacauucuauucaucagcacauggaacauucuccaagagagaccauaucauaagccacaaaacaaguuucaauaaauuuaagaaaacugaaauuauaucaaguacucucucagaccacgguggaauaaaauuggaacucaauuccaaaagcaacccucaaaacauacaaacacauggaaauuaaauaaccugcuccugaaugaucacugggucaagaaugaaaucacgauggaaguuaaaaaauuauuugaacugaaugaaaauaguagcacaaccuaucaaaaccucugguauacagcaaaggcagugcuaagaggaaaguucauagcauuaaaugacuacaucaaaaagucugaaagagcacaaauagacaaucuaaggucacaccucaaggacuggaaaaaccagaacaaaccaaacccaaacauagcagaacaaaagaaauaaagaucugagcagaacugaaugaaauugaaccaaaaaaauacaaaagauaaacaaaaagcugauucuuugaaaagauaaauaaaacugauagacuauuaacaaaauuaaccaagaagauccaaauaagcuucaguuagaaaugaaacaagauauuacaaccaauaccacagaaauacaaaagauaauucaaggcuacugugaacagcuuuacauacucaagcuagaaaaccuagaagagauggauaaauuccuggaauuauaccacccuccuagauuaaaccaggaagaaagagaaacucugaacagaccaauaacaagcagugagauugaaaugguaauuuaaaaaacugccaacaaaaauaagcccagaaucagauggauucacaaaugaauucuaucagacauucuaagaacugguaucaauccuaucaacauuauuucacaagacagagaaagaaggaauccucccuaaaucauucugugaagccaguaucacccuaauaccaaaaccaggaaaggacauaacaaaaaagagaaaacuauagaccaacauguuugaugaauauagaugcaaaaauccuuaacaaaauacuagcuaaccaaauccaacagcauaucaaauagauaguccaccaugaucaaauggguuucauacuggggugguuuaacauacacaagacauuaaugggauacaccacauagaauuaaaaacaaaaaaucacaugaucaucucaacagacacacaaaaaacauuugacaaaauccagcaucccuuuaugauuaaaacccucagcaaaauuggcauagaagggacauaccuuaagguaaugaaaacugucuauacugaaugggaaaaaguugaaagcauuuccccugagaacugcaacaagacaaggaugcccacuugcauucaacauaguacuggaaguccucgccagagcaaucagacaagagaaagaaauaaagggcauccaaaucaauaaagcgaagucaaacugucgcuguuugcugaugauguaaucauauaccuagaaaacccuaaagacuccuccaaaaagcugcuagaacugauagaugaauuuagcaaaguuucaggauacaaaauuaauguaaacaaaucaguagcucugcuauaaaccaacagcaaccaagcugagaaucaaaucaauaacucaaccccuuuuauaauagcugcaaaaaauauauauacucagaaauauaccuaaucaaggaggugaaagaccucugcaaggaaaacuacaaaacacugcugaaagaaaucauagaugacacaaacaaauggaaacacaucgcaugcucauggauggguagaaucaauauugugaaaaugaccauacugcgaaaagcaauccacagauucaaugcaauucccaccaaaacaccaccaucauucuucacagaacuagaaaaaacaauccuaaaauucauguggaaccaaaaaagaaucugcagagccaaaacaagacuaagcaaaaaaaaaaaacaaaucuagaggcaucccauuaccugacuucaaacuauacuauaaggccauagucaccaaaacagcaugguacugguauaaaaauagcacauagaccaguggaacagaauagagaacccagaaauaaacccaaauacuuacacugaucuuugacaaagcaaacaaaagcauaaaauggggaaaggacacccuauucaccaaauggugcugggauaauuggcaagccaaauguagaugaugaauaagacugaauccuuaucuuucaccuuauacaaaaaucaacucaagguggaucaaauacuuaaaucuaagaccugaaaccauaaaaauucuagaagauaacaguggaaaaaccuuucuagacauuggcuuaggcaaagaguucaugaccaagaaccaaaaagcaaaugcaacaaaaacaaagauagaucgggcuuaauuaaacuaaaaaacuucugcacagcaaaagaaauaaucaguagaauaaacacacaacccacagagugggagaaaauuuuugcaauccauacaucugaaaaaggacuaacacccagaaucuacaaggaacucaaacaaaucagcaagaaaauaacaaucccaucaaaaauugggcuuaggacaugaauagacaauucucaaaagacauaccaaaguccaacaaacauaugaaaacguacucaacaucacuaaugauuagggaaaugcaaaucaaaaccacaaugugauaccaccuuacuccugcaagaauggccauaauuuaaaaauuaaaaaauaaucgauguuggcauggauguggugaaaaggcaacacuguuacacugcuggugggaauguaaacuaguacaaccacuauggaaaacuguggagauuccuuaaagaacuaaaaguagaaccaccauuugauccagcaaucccauuacuggguaucuacccagaggaaaagaagucauaauaugaaaaagauauuugaacacauguuuacagcaguacaauucacaagugcaaaaauauggaaccagcucaaaugcccaucaaucaaugaguggauaaagaaauguaguauauauaccauggaauacuacucagccauaaaaaggaauuaaauaauggcauuugcagcaaccuggauggagaccauuauucuaauugaaguaauucacaaauggaaaaccaaacaugguauguucuuacuguuaaaugcgagcuaagcuaugaggaugcagacauaagaaugacacaaugaacuuuggggauucaggggaaaggguuggggggaggggugagagauaaaagccuauacauuggguauaguguacacugcucaagugauggauacaccgaaaucucagaaaucaucuaaggaacuuauucacguaacacacaccuacuguucuuaaaaaccgauugaaaucaaaaaugacaaaauauauuaaaaacaaagagaacacucugaaggaccccaggaggagguuagauuagacucuaguuggcccagaagaugggauugaaagacugaggugggggcaggaggaaagagggagauccuucauuucccuuuccucccaauguccuuuuuuuuaaaaaaaaaccuuuuauuuuagguucagggguauaugugcaagucuguuauauagguaaacucgugucaugaaaugacagaucauuuccucacccagguauuaauauucagccuaguacccauuaguuauuuugcccgaucuucucccuccucccacccuccacccccagguaggccccaguguguguuccccucuauauguccauguagucuaaucauuuagcucccacuuaaaagugagaacaugagguauuugguuuucuguuucuguguuaguuugcuaaggauaauggccuccagcuccauuuguguuccugcaaaggacaugaucucauucuuuuucauggcugcauaguauucuuugguguauauguacuauguuuucuuuauccagucuaccauugaagggcauuuagguugauuccaugucuuugguauugugaauggcgcugcaaugagcauuacuguccuuucuuacuuaaggguuuaaaaaaaaaaaaaccugcauaugaagaggguacauugagcaaacugacuaaugaaacucaaucucuuauuuccuguccuuaaaagaaauucauuuuuaaauauaccgaaacaucuucaaaaaaaacaaacaauaccuggcccccaacauagccccacauguuucuugcacuucugaaguuauggcauauagcacuggguggggacgaagcugugaauuaaaauggcuggcugagaugcagaggcugagacgcaggggcugagaugcagguacaacacuuaccuucugcccugggaagauccaggugaacuccaccuccacaucgggcucccccaggacagugcagagcacacugaugucguccccacuuuucacuuuguuugaagaagccaagaugguuguugagggagggccacugggaacuggaagcaagcacgaaacaggcagagugagaccccgaguguaaccuugaaaacaaaccuacagaugcauucuuuuccauggagagagauggaauuuucugccuuucucacagcucccugaccagugcgaggacagugugagcccacaacuuggggcuuccuuugaagccaccuuuaucuguugaccuugguggucuggaaugggguaggcaccaggacucccaggacagccuccaagacugugauuaggagaggaagcucagagguccaucaguggucaugugaagagaaugaagaggugagggggaagaagucccuagggaagaagcagggaggaaguacuggguggugguguccacagggguggcagggagcagauagguguguggcugaccauccgcagaagacgaacagaaaaucuaaauguacagaugugaaagauguuugggcaugagugcuaccugggucugcagugccuuugccucaucauguuucagaaacaaauuucuucauuauggggaauucacucaacaagcugucuauuuauuuagaaauggggucucugucacccaggcuggagugcagcugcgcgaucucggcucacugcaaguucugccucccggguucacaccauucuccugccucagccuccagaguagcugggacuacaggcgccugccaacaguggugcaaucuuaacucucugcagccucaaacuccugcauccuggaggaaagcucaagccauccucccaccugugccuucugaguagcuaggauuaagguaugagccacugcaccuggcuaguuuuucaguuuuuuuggucuauguugcccaagcugaucugcaacucauggccucaagcaauucucaugccuugaccucccauagugcugggauuacagguguguuaaugagcaauuuugauggcagccuugagaaaugcuaugugcuagcaggugggccuagagcagggagggugauggaccugaucucugagcccuuggaaucuguauucuagcaaaggggcgggacacugagugagucaucguaugguuaauuuaaaaugcuguguuaaaagcuaugaagcagaagcccagaguacuccaaaaggccagaauagaacagucugagagccaggaagggcuuccuugaggaagcgcuguuugaacuaaaaucucaaggccgagcuucagagacaggaacaggagaagcagggagacaccagcaggcugggaaugcccauguucauggcccugggugagaggcaguggcggaguggaggagggcuggggagaggaggggagggaggagugagaccuggauggggaggaggacagaggugaguccaugugaggccauucaggccacgcaaaggauuuggacuuuguuucugggagaagugggaaccuacugauugguuuaauuaaaaucagggaacgggcacaguggcucacuccuguaaucccagcacuuugggaggcugaggugggcagaucaccugaggucaggaguucgaggccagccuggccaacaugguaaaaccccaucucuacuaaaaguacaaaauuagcugggcaugguggcgcaugccuguaaucccagauacugagccugagacaggagaaucccucgagcccaggagguggagguugcagugagccgagaucacaccacugcacuccagccugggcaacagagccaagacucuguauuaaaaaaaaaaaaaaucagcuacaguguggaaaauggaguggagaaagaaaagguggacauaggggaaaugagaagguauucacauaagucuagggcagagacaaugcuagcuugaucccuuuuuugcagugaggauggagagaaacaguaggauuugaaagugauuuaaugaaaaaaguagaaaggaucgggaggaggagggagguuagcuuggcuuccagccgcaggccugacccgugggugaagguagugccaucaccaaggcagaggaggaggaagaaccagguccagggaggauggcacugaggccagggauggcacgcggaggauggaggaccccgaagcaucucauugcacaccugagguggacggcggacacguggaccugaugcuccuagauccggccacuuccguucacuugggaguuaccaguguacagaugugaagcuggcccagggacagaacaaggagugggaaagaagggugccugggggagcaccagcauuucaaaguugauagaaggcuaagagcugaccaagaagagugagaaagcugugggggaggugggggaagcugggaaaaauggagccagggcagaggcuguucccugcaggugagguggaauccaggaggacagggacagacuuuaauggcauggggguccccgaguaccuuggcaauagccguuuugguggaagucaagggagaaggccagaugggagugggcaaaggagugugugggaggaaaggaaguggagagggacauggagagcucuuucauucagggacuugguucuaguggggaagaguggugggcucagcaaaacacugggggagguggagcagggcugugagagggauuugguaacaggguguaaggggcauggccugcugaauaagcaccauggcugagaacacgaggcaugacagaacccaaauucuaacuucagagagcagcucacucucggggcuacugauccccccgacaggguggcugagaagcuccacugcaggggauggacucugcccacacguaccacucuccccuggucaaggugagaguucucggagagacuaaagucaccuuugagggacuacagugccagaagagaaacuauuuccccuccucccuugcaaggcuggcaagagggugcuucacuccagaaaggcgagggagcggccucagagaacugcuugccaaggaaugugggggguguugcagcguucugcaacgcaacugcuccuagccugccccuaugccaucagcccggggcaaaagagcucuggacaagauggcagggugggggacuucgagaaguaaagagggcccagacugugucuccacuguauguucugguggccacgugcucuggagucaggugaucagguagacacagagaugucaggacuccaggcucuuucagccaugcugcagcucagagcaaagaaguucauacaagcagaggcagccuccagcugaggguccaggagaaggcgaggcugcaugggacagggccuaggacaccaagggggcuugugacaggugagucccuaucaccugugacaaaccacuggagucacuaucuguucccaucaggcuaacagacaacaagccaggucagcauuuauuaccagggacugccagcucucacuuacuuccucugaccucucucacuuacuuccccuaaccuggugccccagcagggaggggaggggaggggaggggagcggagggaacuguggccuccgacucagagcugcugcacucaccauggagccugcaugugacaggaagagcagaaagcaggcuuggaugaauuguugggacugaagauuuuaaacaaacagucuuagaaaccagaaugaggcugucuuacucacccagcaagccuguuggauaucaaagggaaacucgacaugaccaacagaucucccuacccucaggaaaagggggauucaacacaauggaacggauggcaguuaccagggaaaaaaguauuucauguauaaaugcuaugaaaugaaacuccucacuaaaauggccacauugaaagaaguaguuccaauuuuaauugagagacugaucauguuucaguucugucaagaguaagggaguaaggccaacuggaagagaaugaggcgggaauuugagaacuccaaguguucugugcacauuggggaaaacagaagaaagacgggacaaaaugcagaggacaccaggcaggguagacgagagaugggggauucauggccaugcccucuacccucccaugggagugucccaacagcucuuaacucucugaguacaggcauggggagaagguuaguuguguucauccggggugguucuuuccuggacaggagaggggaguacagagaggagggcgugccggguguggguagugaguacugauguggugggacccaggaucuaagccucauggguggggagggcagaaagcccucaagaacagggugggugcaggugaggacuguggcugagggagucauugaacacagaauccugggaaaguacaagccugugucacuggagcuggggucagccccggugguugcugucacagugguugugguugacauguucacauugugaugagggugggaauaucugagguggaacggaugagggguccaugaaccuggccaguggguaccaagucgauaucaaagucacccuaaaaauggagugacaagcagggccaugaaccaagugccaaaauguucgaugaaugcaugggagugacaggaaaggaaaugagaaugcugguagagcccccaaagagcagagguucccaacagaagggcagagaaugaggguuggcagguggcaauggguacaagaaggaugccagccuugacgugggaaugaaugauguccuuaggagacagcagauuuggguuuagaccaagaggcugggaggaugcucuaaaggaguuuggggacauagaagaccugauccaacacagaggcagcaccagagugaacgauggaaggauuuggcuggaauggagaagagggguuuucggucagggucauaacaaggaaggagaacauccauccuagaagugguggggcagaagggaagccuuuaagaacggcauaagugggccgagcaugguggcucacacuuguaaucucggcacucugggaagcuaagaucaaaggauuguuuaagcccaggaggucgagaccagcccaggcaagguagggagaccucuucucuaugagacaaaaaaaaaaaaaaaaaaaaguuagcagggcaugguggcucauaccugugguuccagcuacucaggaggcuaaggagggaggguugcuugagcccagggcuuuaaugcugcagugagaaaaugguugugccacugcauuccagccugggcaacaaaacgggacccugucucaagaaaaaagagaaaaaaaaacaacaacaacccaacaacaaugaaacaaaaggcacucauggagcuuccuuauuccaucugcaggcagggaacagcaguaccugaaacugaccaggggacuaacuagaaucuaggcagggguggccaggcuuacccgccacauagagcagcugguacuugacggagaucugagaucugcccccggccuccgcccugcaguaaaccacacccuggugcucggaaugagguugcagauacacaaagccccgcuucaugucauaaacaauguccguuccauuggcugggaucuccuuggcugggaauucccuguggagcgugacuuuggccgacagcacggucacccgacaaggaaccacagccugucuguccggguucaaguagacaacaucgaaguagcugggagaagguacaaagaguucuccuuucucugcaaagggaaggaagacacaggcuuauucacuccggagacgcaaaguaaaagcacccuuaaggauuuuggcagcauacucugaauacugaguccuuaggaguaggaaaggccggguuuucuuuuuuuacuuuaaugcuuuucauuuuuuggaagaaugauuuaacuuccugucuccuuaaagaaaacagaaggcugggcgcgguagcucacaccuguaaucccagcacuuugggaggcugaggcgggcagaucacgaggucaggagaucgagaccauccuggcuaacacggugaaaccccaucuguacuaaaaaaaacaaaaaaugagccgggcaugguggcgggcgccuguagucccagcuacucgggaggcugaggcaggaaaauggcgugaacccgggaggcggagcuugcagugagccgagauagcgccacugcacuccagccugggcgacagagccagacuccgucucaaaaaaaaaaaaaaaaaaaaaagaaagaaagaaaacagaaaagguaucaguacaagcccagaugacgcccauggaucaccaccaugaggaagcaaggaacaagauuuaaauuaagauuuaacauauuaaccuuuaacaaguuaaaguuuaacaugcccagccuuacuucuuauacuauaauauauaguuugaaguaagugaccacacuaguugcuuuaaaaauauauuugcaaucuggccaggcgugguggcucaugccuguaauccuagcacuuugggaggccgaggcggguggaucuccugagcucaggaguucaagaccagccugggcaacauggugaaaccccgucucaacuaaaaauaaaaaaaaaaaaauuagcugagugugguggugcgcgccuguagucccagcuacaugggaggcugaagcaugagaauugcuugaacccaggaggcagcagagguugcugugagcugagaucaugccacugcacuccagccugggcaacagagcaagauugcgucucaaaaaaaaaaaaaauugcaaucgguagcuuccaucaacaaaaaaauguguuaaagcucauuugaauaauuauagauuacauauguccccugaaaauguauuuacauccacucauguagaugacacacguauuacuuaaaguagacaagcacauuggauuuuagauuuccacaaaaaaucaagcuaauaagcuguaaacuacauccaaauuacagcaaacucaauauuuaggaaagcacuuacuaaugugauuuuaugauuguaaguuuuaaacccuuagcaguuguaaaaccuugaaaccaucugcugcuuguggguggagaaaucagccccacagccacagucaguaacugccagccaggaagcauuucccaguacaucagagcuccccugggagccccagcacggugacaguguccucagccuguccucacacagcccagaggaucuggcgccugccaagguuagcggaggggaauggcgucggcuugaaggaggaacccaucagucucaggucugcucucggcuuggccagcaccuggcugggaauccucagccagucucuuaucuccccccauuuccucugaaauuacucugccugguucuuuaagcucagaugauggcauuuuuaucuuacugaaaugggagaaacgaggacuggccuaccaauucuguccuuaggacaggcaagaaacucuggacugggcuuuuggggguauuuuuguuggugcugguggcuuuucuuuuuuggcaugguacauugaauccuuuguuuuucuggaucauucugugagggaauauuacaguauuugcaaagagaaaucuucagagcuagugauaccccaauacguauuacaugcuuucuuguguuuuccccacaguguuccugaaauaaauaauuuuucuuggcuuucuuccccacuugccuucuuugugucacaguuagaugguguuuuagguugggggcagaauuccuggacacaucaucaaaugguucaugagccaagaguucuugggcuguaaguaccaaguucacuaacacggagauccuuccuccugacucuaagacgagggaagaguauaucauggcucagagagucuccgucuuuuacauggguuuccaucaggcugggaggucugugcaacuucauaagaaauuggcuuucaggcuuagguaagggguaccuuugucaacgucaugccuaauguucaugaguucacacagaguccaucuacauggccucaaaggcauuauuuuauuuccucaugcuucaauguccacauuugucaagagaagaaucuggaguggauaauauugaagauguuuucuuagcaacaacacuuuaggauuuuaugauugcaagauuuagaggcaacuuuuguuuuaaaaguguguagaauaaucugaagcgauaagcagagccauuagucgaauaagugaaccgugugaauuuaagaacacaaaaauaucuucuuguauuuuuauuuuuugagacagggucucacgcuguugcccaggcuggagugcaguggcaccaucaugacuuacugcaguuucaaccuccagggcucaaaugauccucccaccucagccuccugaguagcugggacuacaggcacgugccaccaugccugucuaauuuuuuauuuuuuaguuuuucuagagucagggucucacuauguugcccaggcuggucucaaacuccuggacucaagcaguccuccugccuuggccucccaaagugcugagauuacaggcaugagccaauguucccagccuuacuucuuauacuauaauauauacuuuacuucuuauacuauaauacauacuuugaaaugugaccaaaccaguugcuuuaaaaauauauuugcaauccguagcuuccaucaacaauaacaaaguguugaaguuuguuuuaauaauuauagauuacacauguccccugcaaauguauuuauauccacuuaucuagaagacaaauguuuuacuuaaagaaaacuaaacacaugggauuuuagauuaaaaaaaaaaacucgaccaggugcaguggcucacgccuguaaucccggcacuuugggaggccaaggcaggcggaucaugaggucaggagaccgagacccuccuggacaacauggugaaaccccaucucugcuaaaaauacaaagauucguugggcacuguggcgcaugccuguaaucccagcuacucgggaggcugaggcaggagaaucgcucgaaccggggagucggagguugcagugagcugagauggugccacugcacuccaaucuggcaacagagggagacuccaucucaaaaaagacaaaaaaacaaaaaaaugcgggggggggagggauagcuuuaggagauauaccuaaugcuaaaugacgaguuaaugggugcagcacaccagcauggcacauguauacauauguaacuaaccugcacauugugcacauguacccuaaaacuuaaaguauaauaauaauaaauaaaaauaaaaauaaaaaaauaaauaaaugcaaguuaacaagcuauaaacuaaauccaaauuacaacaaauucaguauuuugagacagucucacuccgucacccaggcuggaaugcaguggugccaucucggcucacugcaacuuugacucgcugccuccuggguguaagcaauucuugugccucagccucccgaguagcuggaauuacaggcgugugccaccaugcccaccuaauuuuugcauuuuaguacagagggaguuucgccauguugguuaggcuggucuugaacuccugaccucaagugauccgccugccucggcuucccaaagugcuaggggauuauaggcaugagccacugcacccagccaggaaaguacuuauuaaugugguuuuccuacguauaaaaauuagagccucagccuuuuacuaugagaaagcucugcugcugguaauguucucauccuugaucugggugggaguuacaugugccuguuugcuuaaggauaauuuauugagcuguauucugagaauuugaauguuuuucuuuacauauguuauacuacaauaagaagugaaagagaagcagggaaaaccuuccaagauccuccuggaucaagaugaaagaggaaauacauacggcaauuauuuaaucacaaacugcacacuaacaacagucagucccccaaaagaagcuucaguguuuuuaaucaaacucuaggaaacauacaaacauaaugaaugacaaacauuucuccacauggguagccaggaaacacauguucugaaagaauccugagccagcagugagaaccucagcuucuguaacagcccaucuugguuucucaaagccauccaugcuugaaaagacaaauugccaaacccuauaguaaaaauccaacuggacuccuagcuuaguguugacaaauaagaaaaaauaaaugauguauaacacauuaggucaaauguguuacagcauuuauuuuuuuugaucaaaguuucuugauaguuggaaugaauauauuuuagcuuuucuuugguucccaaaauuaguucaguuaaaaaaaaaacaaaaagguuccgccuccaaaacucaaagagagcccguauuuuuuuuuuuugagguaaagucuugcucugucgcccagguuggagugcaguggcgcaaucuugacucacugcaaccaccaacuccgagauucaggcgauccuccugcuucagccuccugagcagcugggagcacaacugugcaccaccacgcccagcuaacuuuuguauuuuuguagagaugggauuucuccauguuggccaggcuguucucgaacuccugaccucaggugauccgcccgccguggccucccaaagugcuggauuacagguaugagcuaccaugccuggccaagagcccauaauauuaauaggauauucugcccaagcuaagccugcaguucaaaaccucgaccaauacuuugggaagacacaacagugcuaaucuuggcaaagaaucuuccuucugcaacuugaaauguggaaucagucauugacuugaauaacagacuuuuauucaucuuaguugguugcuuuuuccacuguugcuucacagcaugguauaauacaaagggcacauuuacaaucuuguguagcgaguuccaaaaugaagauccaaagagauugccuaugaacaauuauuagcaauucuccugacaacaccaguuaugcuagcuagaaucuggcuaucaguccauccuucaccuuguccuacaaaagguucaaggcaguaaaaacacuggauccugggucagaaaaacagguuuggcuccuuauugugccacuacagguccuggaacauugaggcucagcaugagcauuaguacuucuaguauuuuggagauaauaaaauagcuuuugcuuauuucccagggauguuguggaaugaaacugauagaggcaggaggcagagaacucuccuaagcagauacgggaauguccuuagagaaccucugaccuaccaaggucauugugcacaggggucuugccuaaacauacccccagugaaaaauuccaucccuuaacacacaugcaguaagggaaauaaaucaacguggagugacucagauuaagggccugcagguacacugaaaggaugggguggagccgccaggaauucacgccucuuacaaacagggaacccagcccuaccgagggaacauagaagcccuuguauucaauuguguggagagcaaccugcaaccugcuuucaggaccccucuuuuugcugagagcuuuccuuuucgcauaauaaauucuacuccacgcacucuuuuaagugucugugugccuaaguuuuccuggcaugagacaagaacuuggaucucugaacuaaggaguaaaaagucugcaucaaaaugagauacaugugcuuccagaacugcagcauacccuacuaaugcaucuccuugccagagaggagcuauuugggcaggaaaggacaaauacauaagauuguacuaaaacauucuuuaauggucagggcauaacauccuuugggucauaggccuaugucuaggucuaggccuaugucuaggucuacgucugaaagguagguggauucaaggcauggagaaauuucaugaaagucccugcccaggcacuaacaaaggauucugguuucaccugaaaugucuuggacgacaauaggacgaggguggcuuuguaagauuccugaaagcucuuacugacuucugaaccuugcuggagaacuucauccccuaaacuucagaacuuagagaacauuacagaagaaagaggcugagcaguuauucugcacacguguuucucaaaaugcaagcuccaucuuccagaaacauacuuugcacugcagagaagaguucuccacucugaccugaacauuuugaggcaguccacugaggcuuagggacagggacuggagacacaacagccacaaucuuugggaaucuugcccccgaaaucucagcucauaguauucacaagaacaaacagggcugagcagaauggcucaugccuguaacuacagcaauuugggagaccgaagcaggaggauagcuugaguucaggaguucgagaccagccugggcaacacagugagaccucacuucuaccgaaaaaucaaaaaacaaaauaauaaaaaggacaaaugggaggucuuuagugaagcauccuauggaguuuccaaaaagaagauggucauagguucugagaagacagugaugaaagucaacagcagcacuguccaauagaacuuucugugauaaagggaauguucucucucugugcugucuaguacaauagccauuagccacaugcuacaguugagcacuugaaauguggcaagugcacugagaacuuguucuuaauuuuauuucauuuuaauuuucauuuaaguagccacacauguuuaguggucaccguauuggggagugcagggacagacccuggaaccaaaugguuuguguugaaauccuguuaccaccacuuacuuucugugugaccuuaaggacuuauuuaaucacucuaaaccucaacuuucccaucugaaaaaaaaaaaaacaggaauaauauuaguauuugcccugaaggguuacgguaagacuuacaugaaauaacugauguaaagcauuuagcccagagccuggcaaacaggaagugcucugauugucauuauuugcuauucagcaugcagugggggaaccuucagcucucagcccgguccagaaguuugaagaguuccauuaaugcaccaaguauuuuaccuguaaaaaagauguagguggagcccguuuuggccucguccuuccugcagauguagccgcugcagagcugcacccagcagcugaauucaccugugucugccgagguggaguugaccagagucaacuggccguagcgcucauucugcuugacgcuaggaauaaaagacacaugaacucaaagcaagucagaccuggcuggggcccuccagcugucacacucggcuccacuguucucugggcagacuugccccaaucuuucuccgaugucauagaguaauauaagaauguguuugacuugucaaacaccccuagaacuuaaaguauaauaaaaaaaaaaaaaugauaaaaacugaaaaaaaagaaaucaggaaaaaaaugacauuuuuaccuuuuaaaguucauucuaaaacaauuugagcaacaugauggauuauucggcuuuucagcguaauacaaugagguaaauauuuuuugcaacaauucaaaaaauuuuauucauaaccguauuucuggauuuuacuacuguuuucauauuuuaugcagugaucaaauacauagaaauguuaaucgugaaaaugcaauauuauacauuugucaaaacucaaggaaugagcaauacaagaugugaacccuaacuuaaacuacggacuuuagcuaauaaugauguauaaauauugguacaucgguugucaaaaauguaccacauuaacguaagaaauuaauaaugggaaaacugugugcaggaggggaggagguaaauggccacccuguaucuuuuucuccauuucucugcaaccuaaaaccacccuaaaaagcaaaaucuaucacuaaaaacugaaauauucuguuuuaagaaaauaugaauauuauuuucaccauacauugcuacauauuuuaauaaaccaaugugucaccacuaaaauaaauuucaaaaaaaagaauguguuuggcagugguucaugccuauaaucccaguguuuugagaggccaagaugggaagauaacuugaggccaggaguuugagaccaaccugagcaacauagcaagaccccauuuuuacaaaaauuaaacaaugagccuggcaugauggcugacuccuguaguccuagcuacuugguaggcuaaggcaggaagauggcuugagcacaagaauuugagauuccagugagucaugaucacgccacugcacuccagccugggugacagagcaagacccugucucuaaaaaauaaagaguacguuucugauaaaugggugugugggggaagcagagagaaaagccucuccucaaaggaaauaauaaaugucaaagagaauuccucuucuuggagaauguaauuguccucagaccugcgguuuccuuaaguaaaaccauuggugcaauagcuaugcagccucagaaguucagccagaaagccuuggccugguguuuugcuuucagccugugucucaugaaucguuuguaagcagucaacauaaaugaaagcacacagcauuaugcaauauccaaaaucccuuucaucaauaaagauaagucucugcauuaacucuuagaaucuuacacaugcuacauuaucauguuaaaaccaaaaacuuucuuuuaggaagaaaacgcauuggcugauaagguccugagcccaaaguaugcauacagcccacuucuaauaaaguauuuaaaggguuugggcauuucgacuuuuccucugaccuuacucuauuauuucuucuuuuauuuuucuuccuuaucuuuuguauuuuguaacuuguugcauggcaaauauauuugcaaaccccuucaguuucuuucugaaaugaagaggggcauacauauuuauuauuaaacacuagcauuagccaauuucaaugguaauuaauucuauuauauuguggcacaaauccagauguaucagauuuaucauccucacacuggagguuccccugaggcugagagccucagcacaugggggcgccaaaauaagcaguuuuaaucuggggacucaucucgaacauccaaaugcuucgcucuucugagauccacauacuuuuaugauguagcugagauucugcaguuuaucuugcagcagaaucaauaccgugaccaguuuacauuuagcauagggaaaaugucaggugaguugguccugaacgcagcccuguucugguucacugcggaauagcuuguuuuguccaccaguucugccaaguggugcuucuguacucccacgccaucaacugccucccuuacccugaacggaaaucucuccuccuucaggaagcuucuaauuaggaucgacucucaggaaucuccccacuuuugccugacauaauugacuuccuuguucucuaccccucggauaccccuggcuuccugucauuacacuagaugguacaagcuuugaggcaggaacugaacuguauuuguuuuauauucucuaagcaacaaaucugugcagaguaugcaguaaggacucccuaaacaugagcgaauugaguuaaaccagugauggaaaaggaaagaaucuggagaggcaggcauccagcucccuauuuugcagagggggaaaacugagucucagacagcagaaaugacuucccugaaacccacagcuugugaaucgcuugugagcaagucuuccuuaagucaauuaaguauguucugaauaccacucauuagauaagaaaauacauacaaagccccuugugcaaugccugauucauuguguuaucccaauuauaucuuaauuacagaugaauaguaguaaucaugaagauuacuauagccaugacaaauaguacacaugcagcacuggggauaguuagcacagcaaauaaaaaauggucgacccaggccaggugcggugguucaugccuauaaucccaacacuuugggaggcugaggcaggaggaucgcuugagcucaggaguucaugaccagauugggcaacauagcaaaaccccauaucuacaaaaaauuaaacauuagccaggcaugguagugugcauguaguccuagcuauucaggaggcugaugugggaggaucucuugaguccaggaggucgaggcugcaaugagcuaugauucccaccacuguacuccagccuaggcgacagagcaaaacccugacuuaaaaaauaaaaaauaaaaauggaaagaucaaugcuaguuuuaaggaugaagcuagauuucagcaaauuaaaaaaaaaagaaaagaaaagggaagggaaaauggaggcgacagucuccccauguggacaauaauuucuggccacauucccguagagcucagaaccaggguaccaaaucagcaggcaaucaguaaauucacugcgcaucuucucugggccgagcauuugcuagcacuguagugauagaaaguauaagaugccauuccuacugggaaaguaauuaggcacguaagaaauuaacacuugggaauaacccuaccaccagugugcaaucugcaugcuguaucuuuaguagguuugggggcggaaggaaggaaacgcacuggaaaacaguucugcauuuuuccacccccucuucuacgcaaacaauauaaaacaggaaacaaauuauuuagugggauuacaguuucagggccuggauuuagaauguccauuucuaccaaugguaucucaucgucuaggcagcagacuacgcaagggguuggaagugaccgagggccucugcaggcugaguccgugucacgcaagggagacaaggauucccugagcccuucagagccagugucuguacagagaugcuucaucaaagacccuuccuuucuguguaaccgcugaacaccauccccagggauggagaaaguggcgaauggggaguuuaaguggagcaaaaagaaggugucaugaccaaaugccaggaaaaagcguccuaagagaagcagaauucacauuaacaggaagcagcucugaacacgccaacacaucagcuugccucuggccuuuucuuucuaaacuaggaguucuagcccugacccacagagaucucagugauggccaaguccauguuucaaagugaaaguguucaaauuuuaagaccccguguauguguaugugugugcauggcuuccaacacgcuccccuggccuuaacacacacagagucuugcucccaucaguggaggacugaagcuuccuguauuuagcccaggcugcucucuccuggggguggccuaagucaugagauggcacagaggagggagcugacaguccucagauauagggaccggugcaucuuacuuggggcaguggccaguuaauaguagugggguccauuuccugucugccccggugaagacucugcaagccaagggcaagggugagccuuggguuacaagauaaugauucauugguauuauacccacacauacuuaguaaguacaaaauaaaugggaggugcuggagaggacaggagggaugcaaugaugucuagagaagucccugcucccgaguucuccuacacaacaugccaugagaacuccgaggagaguaaccagcaagagccucuaggccaagagggucuugguacaaaggaaggaugucaacaugcgcaaaucgagggcaugcagucccagggaaggaggucuccagagagaagaaaaaaggcaaguuugugcagaacaaagcgauguuauucuggacgacaaguuggcugaagacuguggugaaaggcauaaaaucaugaacuugggccaggcgcaagugguucaugccuguaaucccagcauuuugggaggccgagguggguggaucacgacgucaagagaucgagaccauccuggccaacauggugaaaccgcaucucuauugaaaauacaaaaauuagcugggcgcgguggugcaugccuguagucccagcuacuggggaggcugacgcaggacaaucgcuugaacccgggaggcggagguugcagugagcugagauugcggcacugcacuccggccuggugacagagcaaggcucccucucagaaauaaauaaauaaauaaauaaauaaauaaauaaauaaauaauaacaauaauaaaauaaaaucauggacuuuggaacccuacugaccagauucaaaucccagcuccaccaugaccuucagaguccuuagcuacagcucgucuuccacagucuggcuucaccuacucuucagacuuguaguaacaauaaugauagcuaaugcuuguugagugcaggcacgcugccaagcuccguaaacaaguucaggacuuagaacagcaucugccacagagaagugcucaauacaucuuguuuauucguuuagagauagggucucgcucucuugcccaggcuuugaguacaguggugcaaucauagcucacuacagccucaaacuccuaggcuuaagggauccucccaccuuggccuccugaguagcuggcaugugccaccacauccggcuaauuuuuuuacauuuuuuuguagagacagggucuugcugcgucgcccaggcuagucuugaauuccuggccucaagcaaucucccaccacagccuccccaagugcugggauuacaggcaugagccaccacacccagacucgaaacacuuuagaaauugucauuauuauggucccccugguucucacagcuacauuaaguuggagguacuauuuuuccccuuuuacugcuugagggcaccgaaacauagagaagcaacuuguccaaguuacucagcuauugaguggcagagcaucuaaucuagugucacacagacucagguuacaaacacuuauaaauuaagagggcauggauuuucauccuacagaaaugaaaugaaaugaagcaauuuugacugagugauggcaccucuaacagcuuguaaaaucugcuaaguauagcuaugcacacacacacacucccaaaucacaaacaaaaauaugagagauccaguuaaaugagcucagaauuuuaaauuccauaguagaaacgguacacuguuuucuauuaagucaacacuaaaccauccgguaauuaauuaaaggaaacaagaaugggacacccaucaguuauuaagcaucgacuucauaacuggcaauacggaagagacacuuuacuuuuucucaaucccgugagauggcaaugaugagacuuauaacaauaacugaaacuuaagcaguguuuaauaugugcuaagcaaugcuguaagcccuuuacccauuuugacucauuugauccucaugaagcccugagagauaagugcuauuauuaaccccacguggcaggugaacaaacaggcuggagagguuagguaacuuucccaaggcuacacaggaaguguuggagcugccagagaagaauuugaagcucaguucaaacaacuuucccagggugccucagguagauaaacaaagauuuucugcuuugaacgcucugugcugccucuguuggaaaaagagagacccccaucucuacaaaaauguuaaaaauuagcuggaugucacgaugccagccuauagucccagcuacuugggaggcugaggugggaugaucacuugagccugggagcuggaggcugcagugaccuaggauugugccacuacacuccagccugggcaacagagggagaccuugucucuaaacaaguuuacaaaauuaaaacauaaauauccuccuuauucuacauucaugugaaaaacuguuaggccucuaccacaugcaaggaacugugccaagaaucaagagcgauaaagacucguggguauuugcuugucuguguuucaaguguuuacacagggccuguauuuccuguaagucuccgucucagaacgugucagagaagaauggcugaaugauaugcaggaaacgugccauaugaacagaguacagauccugggaaacagacagcuggguaaaacauacugaaacugucacuguuuauguuucuuuaaaaaagaaagaaaaaauaugcaugaugaucucagggaaacaaauaugcaaacuaaaggacuucaaagugaauauaguucuuguaucagaaauuaggcuggaauagcucuauuccucuaucaucuaucaaucuaucuauuacgaaucaaucuaucauuuaucagccuaucaucuacugaucuaucaucuaucaaucuaucaucugucaaucugucuguugcccaucuacuaucuaucuaucaucuaucuccacauuugcauacuauccaaggaacuauucaaaauccuugcaaugugauacaauauuuccaccucaacaaccaguuacguugugaaauguggcucaggucucucuacugcaaucacuuaugccagauuccucuguauuauuaucuuauuauuauuuuuaagguagcuuuucuuuuuugagauggggucucacucuguuacccaggcuggagggcaguggugugaccuccgugggguucacaccauccucccaccucagccuucugaguagcuuggacuacaagugcacacuaccaugccuggcuaauuuuagcauuuuucuguagagacaggggcuuccuacguugcccaggcuggcaucgaacuccugagcuugagcaauccaccugccucggccucccaaagugcugggauuacaggcaugagccacugcgccugggcuucucuggauuauugaaaaagaagucacccuaagcacuuccccacuacuucacgggagacugcacacgcuacaucccuccagcccugccggcaucacucucaccccugcagguccuauucuuggcacugccuggacucugcccgccauacugcgaagucccccuucccuuuucauuuccccucugucaccugcuggggucaucauucuuuuugacccucuguccagcauauccagguccuuuacaaaggaaaagcuccucuuccuccuucagauauucucuagacucugagaaaaugagaagcguauauccccuugacaccacaaaccaaaaccauaccugacacaccagcgauccucccaacagaaaauccccuccaaccaccuggaacaaaggccuuaaaauacgcccaacaauuccacccagaggaagagauccuugcuaccuagauguuagcuaccgcaaugacagugaucguaaaaaauggggcaugaucuaagagauggagagacccaagagauuuagcuaaaccuacuacaguauuacagccauaacucacaaaaaauauucaugguagauuaggugcaaaguuaaucaugaaagaguuugaauauuuugauaauuuuacacauaaaaauauucacaauagauuacgggaaaaguuaaucauaaaagagauagaauauuuugauaacuuuacacauaaaaaauauucacaacagauuagggggaaaguuagucauuaaagaguuugcagauuuugauaccuuuuuuauacuaaauacaaaacuagaagauucaacauuacuguguuaaccacguuucuugggguuuucagugaucuuucuccuuuuugcuuauuuauaguuuuuaaguuucuagaucaaauaaguauguguuauuuuauaauaagaaaagaaaaacugggccaggugugguggcucacaucuguaaucccagcacuuugggaggccgagguagguggaucaccugaggucaggaguuugagaccagccuggccaauauggugaaaccacauaucuacuaaaaaugcaaaaauuacccggguaugguggcaggugcuuguaaucucagcuacucagaaggcugaggcaggagaauagcuugaacccgggaggcagaggugcagugagcugagaucaugccacugcacuauggccugggcaacagagugagacacugucucaaaaaaagaaaagagaggagaagagaggagaaggaagaaggaagagggaagagagaaaagaaaagaaaagcuauaauaaaagcaaaacaaguaaaacugcuuauaaagugugaaacagauacugcauaaaugcguaagcacaagggcucauguguauuuaaauaccuggagguuaguuuuacaaaguguugccuuuuuaaaaugugaauuuccaacaggcagggccaccaagaauuccuuuagaggccuaaaacuacuguguauuauuuuguucugauuaauggaaacacugccaacuggaguauaacacaucauuuggagugcagcauggcuguuucuuagccauucugcuccccugccuguguggaccugccgaggcugugccaccuccccuggaguuuaacccaggcucccagaucuuagcaagccuuccuucuuacuugguucccacucucggcauuucuaguucuuuccaccgagcugcaacuccaccugucacccaggcugcuaucaccauugacucucucauuucuccucugucagcugacaaaucagucuuucuggagaaaugucucccccauccccuucagaugccuuucaucacguaucagauauacuuuccugaaaaucauuuuaucauuaccuccaguucuaaauauuagcuucucccauugcacacagaauugcacguuaccaccucugccugguauuccagcuccuuugcucucccagcccuuaagcugaguaacccggugucuuuagccaucuagcuccucaccaaacccagacacaucggcucauuuucaccucugagcccuccacgcaucucuuucccucugaagcgcucucuucuucuaucugaccaaaacgugguuacucgucaggguccuauucccaaggaggccgaccauguccaguggccuuuguaaaagggcgguuaagagcaugcacucaggagucagcuuuccuugguucaaauccugccucuaccaguuacuggcuaugugaccuugaacuacgguuaaaggugacaguguacagaauagaagagaauucagugagugaaaguggguugaauaacuuaucuaagaguccuuacuuuuugccucccuuuuuuauccaaugugaguuaaguacaagugccaagaguacuuucagaacugagagggaccuuaaagaucaucugguuggaugucucacuuuacagagaugaacugacucauccaagguuacaaggccagcuagaggcagagcugggaaugaaaucccuggggacuccugagaaaagagaguuuggcaugccucccacugcguaccgcaaaagaaacaugaguugacuguuuuaaauacguaaguaaguccuaaccaaaugaaugacuuggaggaaauuuacagaugauuacuuuccagauaggcacucaccauguagagaaaugcauggaaauaacaacgaaaucaucaauucucguguaauuuuuuuugagacggaaucucacugucccccaggcuggagugcaguggugugaucucggcucacugcaaccucugccuccuggguucaagggaaucucccgccucagccuccugaguaccugagacuauaggcaugcgccaccaggcccggcuaauuuuuguguguuuaguagugacgggguuucaccauacuggccaggcugcucuuuagcucccgagcucaagggauccugccaccuuggccucccaaagugcucggauuacaggugugagccaccgcgccuggcccuucucauguaaauuugacaaggucaucuuucaaacuuugugaccauauaacucagauguauauggguuacucacacuacagguugagaaucccuuauccaaaaugcuuggaaccagagggguuuggacuucagauuuuucucagauuuuggaguaucugcaucauacuuacuaguuaagcaucccuaauuugaaaaucugaaaucugaaaugcuccaguaagcauuuccuuugaaugucauauugcucaaaaaguuucagauuuuguagcauuucggauuccggauuuauggauuaggaugcccaacccuuacuauaaaucuggcaauucuaaucuuaccauguagcagaagcucaucagcacuucucuguggguaacaucagaaaaacaugccccagcucugcucagcugaacgcucacagccacauacuugggaagaaucggcccuggaagaugagugaggacagaggacaaaggagcaagccucugccacccuugcuaggagaacaagcugugaauuacuaaugggcaggcgugcaggcacagugaguguauuauggccaagucagaauagugaaugcaacagccauggggccuggacccauuugcacccagcacagugaauucacugcggggaaauccaccaaaucucccuccugccaacguuuucaagguaaucgcucauaacaaugccacuuugaugguaaaucuucugaguaacaucagaaaccuaaauaaacaaacuguuuucuugguguagagacuacagagaucuugggaauauggcuugauuugaguuuacuuuacuaaaagcugugcaacaugagcaagucucuuaggcucuguggcucaaucuagucacuuuuuaaaacguaggguucaagccacaucagugguucuccaaccuggcugcauaucacaaucuuuugggggagguuugaugcuguucucuuuggcucuuauuuuuuuuuuuuuuuuuuuuuuuuuuuuuuuacagagucucacucugucacccaggcuggagugcaguggcgugaucucagcucacugcaaccuccaccucccagguucaagcgauucuccugcuuuagccuccugaguagcuaggauuacaggugcacgccaccacacccagguaauuuuuuuuuuuuuccagacagagucucgcucugucgcccaggucggagugcaguggugcaaucucagcucacugcaaccugcgccucccaaguaacugggacuacaggugcccacuaccacaccuggcuaaauuuuguauuuuuaguagacauaggguuucaucauguuggccaggcuggucuugaauucccaaacucaggugauccaccagccucagccacccaaagugguggcauuacaggaaugagccacugugcccagcuggcuccuauuuuauuaucacuauuugagacagucuugcucugucacccaggcuggagugcagcagugugaccauggcucacuguagccucaaccacccaccccagccucccaagcagccaggaccacaggguguagcacuauauccagcuaaaacuuuuuguuuguuuuuaagagauggggucucacuauuuugcucaggcuggucucaaacucccgggcucaagugauccuccugccucagucugccaaagugcugggauuacaggcaugagcugccuugccuggccccuccuuggcucugcuuuguacaagucucuaucuuaucuucaaggccuggucuccaacaaucaggucaucacuuacacaaugauuccauuugccucaccaacgccugcucacagcugccuucucuccuuccuaucagccgcuccacacucacacuugaccacacacugucuucuguugcucuguccuuguaucugguuugucuuuuaucucacuaguucuuaagcugcuugucguugggacuauuucugucuuuuuuccccccucauaagcauucugacuuaguagacugccuuuauauauacauuaagcaaacguuaaugcuauuuagcgugcauucuccucagcagaccaacacugaacugaaggcugugacacacucgcucuggucaccccuccggcucuuguaugggacagugccucccucugccuccuuccccaggaugccuaccagcugaugugauauauugugccaaugcacgagccaccuggguaaauaaacgcaugagggcacguucaacauugauucacuuguaucaauguugguugacucacagggcccccaacccccuaccuuuucccagcuaugaagucaaguucacaaacaacagugcuguuacagggaagggugagcuggugcuuucugaccucugcuccaauguaacugagacaccagaucucaucugggaucuaggcagugggauggagagagaggagugcuuuggacaguaggauguggucugaaaggcagagaccaggggcaaaucaggaugaacucccaaaggcaauccaagcaaagucuuugagcaggaaggcaccaagcgaggcaggagacaggccccugaggccccaggacagaguggacaaguugggaaugcaggacgggaagugacaagagaagguucugggcggacuccccagggcagcaacuuagcagcugcccaccugcagccggcugugugggugggacggagccgccaaggcagccaagcccggacacuggaggcaaaccucugacaucuucguuuugcuuuuuuauaaaugugccauucuacacaauuauacacuaguggacauaaaauuucccauuuuacaucuuauccuuuauuccucuuuucuugcucccuccuuugacauaucuuucaaagcuguuuuauuuacaucuucuauauucaaauacuuggccaaaaaucaugcuacuaacacaccaguguuuacauuugagcauuaaaucccagacgucacccacauguauacuuacuuguuaaagcaacauuucacucauaaaauacaugcaaucacugguacuauaaacaaugcuccaucuugcaagaugccccaaaauuaucaucuaacauaguuggugauauuccuacagugucuuugguuuaacgcacuagcuugacuguauugucauuuucuuacuguauuuuaauucugugcaacacaucugggauaaucaauccuagacuuaccagaaaugcucaagaaaugaaauguuuuguugaaagaaacuuuuuuuguuguuuuuuuaaauacauauuugguguagguagaaacauuauuuuuaaguaagaguuagcagaagacguuuuccccaaaacuauagaacgugcuucaaccaauuuccccuacucuaaugacuagaucgacgagcaaugggugaucuagagaaccuugggaccauuaguaugagcaucagugagcccuccacagugcuauggacacaaagaguuuguaggggauugagacacacgucuaaaacguuucuuaaaacgaaacucgcaggccaaggcagguggaucacuugaggucaggaguuugagaccagccuggccaacaugaggaaaccccauuuccaaucaaaauacaaaaauuagcagggcaugguggcaugcaccuguaaucccagcuacucaggagccugaggcaggagaauugcuugaaccugggagguggagguugcagugagcccagauugcaccacugcacuccagccugggugacagagcaagacuccgucucaaaaaaaaaaaaaaaaaaacaaaaaaacaaaaaacgaaaaacuggcuguuucuuaugauuuaccuccuuuggguacaguauggugaacagaaauagcucaccgauauuuagguggcuuacuaugugugccaagagguuuacacgcaugaccucauucuauccugagaacagcacaaugagccucguucuauuauuaccugccccccacccuuguccugaacggaacauagcuguguuuuucugcaagcugaacgcucucagaacauugaguacacugggggaagucuuguauccugcagccuccacccacccaucucuggggaaauacggagggccugcagcuggugccagugagucuggaaagagaacgcucuaccuucagcauugguuaggucaccuauuugucauuucugggguggaagaccauuugaaggcaaguauuagaguuuggggguggcguuuccuuuugacuggccacugcaaauuagaccccaauuggacccaugcuccagauaagaaugaaggcaaagugagagccuccucaucuucauuuguucugcucagaaaauaaaauaaaacgagcuuuggaggaaagugaguucgcauacaaaagacacucacauaaugauaugaaugcacuuaaguguacugaacuaucuccuuaaaaaugguuaauaugguaaauuguacguucuguguauuuucgaaaaauauaaauuauuugaaaaaaaauaccuuacucagcauaacaccagaguacucuccacaacauuuaccaaagucugugcagauucuuucucaauggugggauucuucuguugauaaccacuuaagauauuucuccuuuucuuuuaaaaugucuuccagacucucccuccagaugcuggaugacaugaugagccuggcugggagcccacucucugcuccaucggcccacccucccuuuguguugucuguggguggaguaagcuguugccaaccguggccaaaugaaaagcccgaugcccucccuucucucuaaaagcuauuuauuguuuuccgaggagccagccaucaaagagaucuccugugccccacgcacuccucccaacucccaguuuuugacugaaaaaaugcuaacauccgaccagauaccagaaaaacauccugaaagacaaugccuggacucuuauuuccuagggagcaggaccagggcuuauuaccacaucagccuaucuuguuuuuacugcugugauguugcugacaacauagcugaaaucuccaacgucuccuuguuccuaccagcauugauugguuauauuuaagccuucguccagacccacuuauucuccguuucaucucauuuucuucccuggcucagcgcggugccaagaauucucuggcuuuacacccuggaaguguguuaugaugagauucaagaaacaaaaugugugcagagaagaugcaaaugggucacguugaucucccagcagggguuauucagauaauccagaauauucuuacacaaaguuuuuaauauuaucaacaaaaugcaagaaaaaauuuaaaaaauuauugcaaaaaagcaugagguccaagaacacaucuaaagaccccaguuggagugaaauggguauggggcauggggaggaaggauggaggcaacugacacaggaagagacauugucuuucuucugaaggcaaugaggacggcuaacccucacaaugcgguuuauauuacucagcaucuucuuucagucucucucccuccuuccuucccucucccugucucucucucucccuucuuucauucuuucugggacagagucucacucuguugcccaagcuggagcgcaguggcaugaucucagcucacugcagccuccaccucccagagucaagcaauccucccaccucagccucccagguagcuacgacuauaggcacacgccaccaugcucugcuaauuuguguaucuuuuuucguagagauggggucuugccauguugcccaagcuggucucaaacuccugagcucaagugauucacccgccucagccucccaaagggcuggaauuacaggcgugagccaccaugcccagccaugcauuuucuuuguauacauauuuagaaaggcuuuaaauccucgacucauaauugcccuaaauuuugcucuaaauuuuuuuuaaauuuuauuauuauuauacuuuaaguuuuagaguacaugugcaugacgugcagguuuguuacauauguauacaugugccaugcugguaugcugcacccauuaacucgucauuuagcauuagguauaucuccuaaugcuaucccucucccauccccccaccccacaacaguccccgguaugugaaguuccccuuccuguguccaugcauucucguuguucaauuccuaccuaugagugagaacaugcaguguuugguuuuuuguccuuacgacaguuugcugagaaugaugguuuccagcuucauccaugucccuacaaaggacaugaacucaucauuuuucauggcugcauaguauuccaugguguauaugugccacauuuucuuaauccagucuaucgcuguuggauauuuagguugguuccaagucuuugcuauugugaauagugccgcuauaaacauacgugugcaugugucuuuauagcagcaugauuuauaacucuuuggguauauacccaguaaugggauggcugggucaaaugguauuucuaguucuagaucccugaggaaucgccacacugacuuccacaaugguugaacuaguuuacagucccaccaacaguguaaaaguguuccuauuacuccacauccucuccagcacucuaaauuucuuaauguggccaacaaggcccuccauggucugccucaccucccaucaucaucucuccuccuaaccuccuucccacucccucgccucugaccgccacaucuuacccaccugcccuucaugcuccaaguuuuauacucuuucccacuucuagguacuuccuucaaacacuucucucuuucuggaauuuccuuauaucuugcuaugcccuuccuuacccagggaacuuucaaauaugagcuugaguuuccuccuccuugacagcauacuucgguuagcaaggcacuugcuaacagacuuuaauauuuuauuaaaauugcuuauuuaauugucuucccuaagauuaaaagaucuaugggauauagagauuuuaucuauuuugcucaccaucuuaucuccaucaucugccuagcagagaccacaaacauaguagaugcuuaugauaaaacagugggaagaaaggaacagggcagaggagucaagaaacagaguguucgacaaaugauaacuacuguugucagaaacaguaccuuugcuauuuccgaucucaaagacaggagauguuuaugggaucugggauggacugagucuggagguaaaaccugaaucaauuucagcaccugaaaauacagucaucagcaaguuuauauuagccucgaagggaucaacuacacuguucaagggggccacugcuccugaaagacccagcaggggacaggggcaugaauaaauuugucccuguguggguacauacacuuacaaaugucugcucccuuuuuaaaaaauguguuuguugggcugggcgugguggcucaugcuuguaaucccagcacuuagcgaggcccaggugguggguggaucacuugaggucaacaguucaacacaagccuggccaacaucgcaaaaccccgucucuacuaaaaacacaaaaaauuagccaagcuugguggcgcacgccuguaaccucagcuacuugagaggcugaggcaugagagucaccugaacccaggaggcagagguugcaguaagcugagaucgugccacugcacuccaggcugggcaagaaagaagacucugucuccaaaaauaaauaaauaaaaauaaaauaaaauuuguuuguaaaaugaauucuauacuguuuaaaauacaacuugaaacugugaccacuacguagccugaaaggcugaaaggaccauagguauaagugggcacauauuguauccacucaguucucauuuggaauguuucuucauuuacuggugauaggaagccaguuguagcacagcugaaaccugccaucuaguggaccuucucaugacaggguuuugcaaacaagcaucgcagaguagaccagaacuccaagagcauccugcaguuacgcucuuccaacagagcucuccuuuccaaauagcccaguaucagguuuucacacucuggcauccaaagagcuacccuaaaucaauguggaauuucaaccacuuuccacgcaaagcuauuccaccaagaaaaaucaaugccucauucuggguaucugcuuuucauuucuguuuugaaucuuuagaaaucagguuaguuuagucuacagcuuuaaaaaaaaauucgaugauuacucucucuugccugaagcuaccuccaucagaccgagaguguacugugaucugaauuuaucucaacacacauaccacagagcucugaaguggggcagccgcucugccucaggaacuagggcucccaaguucugggacucaugcagccacuugccagcuugucccucugaccagccacaucuccucuaugacucucaguucccuuaucugucaaaaaguggggcuuccucgaagacauacacauggccaauaugcccaacauacuaaucauuaaagaaauccaaaccaaauccacaaugagauacccucucacaccggucagaacugcuaguaaccaaagccaaaaauaacagaugccgucaaggucauggaggaaaggggaaguuuacauacugcaggugggaauguggauucauucagccacugugcaaagcaguuuggauauuucuugaagaacuuagagcuaccaugugggccagcaaucccauuaccaaguauguauccaaaggaauauagauaguucuaccacaaaggcacaagaauuccuauguucaugcagcacuagucacaagagcaaagacaaggaaucaaccuagaugcccaucaauaguagacugcauaaagaaaaugugguacauacacaccauggaauacuacacaaccauaaaaaagaaugaaaucauguccuuugcagcaacauggaugcagcuggaggccauuauccuaaguaaaccaacacaggaacugaagacuaaauaccacaugcucucacuuuuaaaggggagcuaaccauucaguacaccucgacacaaagacaggaauuauagacacaggggcccacuugaagguggagggugggaagagggugaggacugagaaacuaccuaucggguacuaagcuuauuaccuggauaaugaaauaaucuacaccaaacccucgugacaugcaauuuacccacguaacaaaccugcacauauacacgcucaaccuaaaaguuagaaagaggaaaaaaaaaaaaacaaaaacggggguauaaguuaacaaucagaaggucccuuucaggucuaaaguucuuugagcuugcucccagagucucaggucacaugaucucaggggccugacuuuagauccccugcaggcucagugccucuggcaccauucauucauagaaauacauauggaggaccuggggcaugcuggagacugugcugggugugaggaaaacaucagggaauaaacagacacccucuaagguuagagacuacagucacugcuguugugauaggaagaagugggacaauucaagaaaugcuuagauaguagcaucauugguuggaugcgggagugaauaacgaaagugguuuucaagugauucccgggccucuggucaagagcaacuggauggaauuagugccauucucugaacugaaggacacaggaggaugaccagguguggagaaagaucaugagcucaguuuguuuauuauuucuuuagagaugggccuugcucugucucccaggcuggagagcacuggcacaaucauagcucacugcagucuugagcuccugggcccaaacuaucuuaccauccgagccucccaaguagcugggacuacaggggugcacuacuaugccuggcuaauuuuuagagguuuuuuuguuuuuuuuuuuuagagauggggucuugcucuguugcccaggcuggagcacagucacagaucauaguucacuacagccucaaacuccugggcccaagugaucuucucaccacagcauccugaguagcugcaacuacaggcauguaccaccacaccuguaauuuaaaacaauuuuuuuuuuagagaugggggucuugcuguguugcucaggcuggucucaaaguccuggccucaagugauccucccaucuuggccuccccuguugcuaggauagaugguucagcguaaauaaaagcucaugaaagauccaagcagauauugugagcaggcagcuagguagcucagucuggagcucagaagaaacguuuaauguaauauaggacaaaucgagggcauucgccagcaaguagagaggaguguauagaaccaacauucaaugucuggaagaguggaggauucagagcuggugaagaggacuccagaagggcugugagacagagagaaaaccagaaggacacaggacugcaaaggccaagacacgaugcuucacucagcuaaauggaguuggugcaggaaaucucaaggcauggaaaagcgaacucuggauuuagugcccuuguugaccuuggugaaaaaaugcauguggaguaauggggccaggagccagguagaguuauugaagaaugaauaggaaaaagaaaaaaagugaauacaaugaggacagagacuccucccagggaacugggugugaagguuaucagagaggaagauggcugcagggugcaugggggucaaggcagaauuucuuaauuuggugaauauugaugaaaaggacccauaaauccuuuucaaggagauguugaugauccagaaugaagaggcaguaagugauguauugaaguuccugggaaaguagguagagaugagauccagggcacggauagugcuuuggccuuaggagggaaaauccucauccuucuucccgucacugguagaucagggaaggaggacauaugaucagagaaacuuaaggugauuagagcuccaauuucuuaauaaguuaggggauaauuucauuagcugaaagucagagagaugaagaugagagguuuaagaagagagaaaaagugaccuuucuagagaaauguauugauuuugccaagcaaacgugagguggccacaucuacuggcagccacggccacguggcgagcuguacggcuccuuccagcaguccucaggguccaugugcagacaagagaaaguagaugaacagggucauuuagggucgcaaguuuccaaguggaaaugaaggaagaacagagagcaaaggaacuuaggacauauucaagaguucaguagaaaugacagagcccagaauuggagacuauuauucuaaguaaaguaacucaggaauagaaaacaucauaaguucucaccgauaugugggagcuaagcugugaggacacaaaggcguaagaaugauacaauggacuuuagggacuuggggggaagaguuuggggcagugagggauaaaagauaacaaauaugcaaauauggugcaguguauacugcuugggugacgacgggugcaccaggaucugauggcucacacuaaagaacguauguaaccaaaugccaccuguaccucaauaauuuauggaaaaauaaaauuuuaaaagagagagagaaguaaagacauaaaggugcaauguggauaaagagggagaagggagagucaauggacuaacggcucuaugaggucaaguaacaauagguucuguauuagucuguucucacauugcuaauaaagacauaccugagacugaguaauguauaaaggaaagaaguugaauggauucacaguuccacguggcuggggaggucucacaauccugguggaagagcaagggaugucuuacgugguagcuggcaagagagaaugagcaccaagagaaauggguuuccccuuagaaaaccaugugaucucgugagacguauuaacuaccaugagaacaguaugggggaacugcccuuaugauucaauuaucucccacugggccccucccacaacaugugggaauuacaggagcuauaauucaagaugagauuuuggaggggaaacagccaaaccauaucaggcucugagacaauggggauggauccaggugacacagcaccauagauaugaaauacauuaauacuuuguuguuugccuagcugaccuaccucccaauacaugcaguguacacaucaguacucaguaauuaucuuuaaauacugaaugaaugaaugacuaagaacugacuucugacaugcggccuaaaccccuguggaagccaaaacauacuuccugagcucugguaugugucagacauuguucuaggugcuaggaaucugaugauaaaccacagauguguuauuugcccucaagggguuuauucuuucaggagggaagaaggacacagaucccagauuauaaagaaguaaucaauuaaauaaacaaauaagcaauaauauauucacauuccagauaaggcaacuggguucuagggaaacuacugaucacacaccacuuugcugguuaguaauaaacggaagauucaaaucuagcugugccucagccucuggcuucucuguuccacaacauucuuugucuuuauucucacugcaggaaacauauaggauaagacauuuauccuuauugaguaaauugaaugcuuucucuguguuacacauaugaaccaugagaucaaguuauuuauauaauaauguuuauaaaugcacuauuuaugauaguaaaaacucaaaaagccacaagcugggaacuagguaagaacacaaugcuauauaacauugauggaauaccauauugucaucaaaaucauaaggagaucuacauaaaaauccauaugaaaucacugcagguuacaacacauuaacuuacugaaauauugcuuuaaacaaauucccaaaucccaaauucauaguugaguggguccuuagagaccaucuuguuuuacaggcuaagaaacugaggcagcauccuugcuaaaacaccacugugaaaaauccguaagaagagauggauuucugcauccuccaauccuagagagaugccaaauuauauuugggugccaugaauguuuucuucauauuguguuuuaaucauuuaccaaaaucacugaugaauaaagccagauacaucaauucauugaaguauuuaguaagcaacugugacauucccagcacuuugggaaaaaaaaauguauauugcauuuuucucuacuugggcauuuuacuuccuagagcucuaaaguucauuagaucuccuucuucuucauuaauugcucucucuguuggccugcuuuuguaggugagugucaagaacauuucacaauuuaguaggaaaagaugaagcagucagaagauuacauucggauaaauguggucgugcuuccagaaagccaacaauauugguuauaacuacaaggcuuggcuggacgaggaggcucaugccugaaaucucaggacuuugagaggccaagguggacggaucacuugaggccaagagguguagaccagccuggccaacuuaccgaaagccagucucuacuuaaaauacaaaaauuagccagguguggcggcagauaccuguaguaucagcuacucgggaggcugaggcacuagaauugcuugaacaugagagguagagguugcagugagcugagaucgugccacugcacgccaaccuaggcgacagagcaagacuuugccaaaaaacaaaaacaaaaaacaaaaaaaacuacaaggcuuuguuggaugaacaccuggggagcuuccaaacccaacacugucauagcccuggaaagaacucauucuacggaaaaaagaaaacacagaaugaauacuucucuauccaaaggcaccacguucugggaacgaugucaagaguccguuucuugaaucucuggugugaaauacaucgugcccccuugagggcaaauagcacaucugugguugauauagcuaugacuagauguuuuucacauuuuuucacaauguuucauaaguuuuuggaagcccacaucugucauuacuuucuucuaaggcucuugcugugcuucgaaugaacacuauucaaagagucaaaauuuguuuuuucacaugcugaauauuucucuucagauuaacgcucacuuuagagucuuuaaaauguuuucaaaugcauuuuaauauauaauuuagauauauuugaaaauacucuuagaaaauacuaaaacuucaagcauggaauccucuaagcuuaagaugcuuuguguaggaagucaaagacuaaauguucagaauaauuuaaauuauaucaauucuguuuuuuuauaaaaagugcaugaaucugacuuuggugaauaaggucguuuaaaauguacgugguauuggaggcagggccgguccugcgggcgcguuggcuucuucccacggaguuacgugcagcccaugugccugugagcagccuggcagccgaucuggccagugggccauuuuacaggaacugagguccagagaggacauggacacccccagcccggucagagucacacggggcucaguggacggccuuggauugaaugugggcuccuaacugccuccggccacuucucacaaacugggauggcccaggucccccagcaaggguacccagcaaggguaacucuggggcuuccuggcugguugcuucccauuggcugccagcugugugauaccacagggcggagucuguggaggccccacccaccuccucuugucaacggccccaucugccaguaagguugaggacucccagguuucacccacuggaggcucaaccugaggaacccuggccaugguggguggguucaccuuggguugacuacccauugggccugccugccccucccucaaaaggccccucgaguuguacaggcuguugggagguggcucagccucgaagggcaggcugcacaccuguugaccuaaacucacuggacagacuccagguggacgccaacuccucaacagccccauaaccuuagcucuaccugggguacccagcacccccgccccaccacagggcuagaggcccugagacccugaaaaaggggcggguaguagggaagguggaggcacacuccucuccuguuggacaggggagcucugaggucaagcccugggcucagccacgcagagacccuggcugcccuggcucuuguuuguuuagguccagguucugcccagaccagggcccaggagaguucucaggaggcugagaaaccuccaggccagacagaaaguuggggccagagcuggguuuuagagauccuacgggauccaaaauagggcggcuaccuagguggggcauggccccuacccgagaacaggaggguccuccagagaaugugccaccaucagggauaugagcugggccugcccagacccugggcaccuuugggagcaggaaaacucaaguggaacuuggaaaggcuuugaacgccaggcuaaugguugaggggauggugggcagggagggagggcaaggaggcucccucuggcauuugggagcaggugaguggagggcggagucccuggagguggcugcagucccuuaauggggggccuugcucugggcauguggggcugucccuccauccagagcuggcccaagacccauagggcccugagugcuggcaaaucucacugcuccugacccggcuuguguauucaaaacacaaacaguaaaaucaacaucaggauguacaucaggaaaaaaaaaaaauguacgugguaaaucccacuugcggguauacauccaaaagaauuaaaagcagaaucucaaagaaauauaugcacauccauguucacugcagcauucacaacagccagaagguggaaggagccuaaaugccuaucgcuggaugauggauuacaaaaauguagucuaggccaggcacaguggcucacgccuguaaucccagcacuuugggaggccgagguggguggaucaugaggucaggagaucgagaccacggugaaacccugucucuacuaaaaauacaaaaauuagccaggcaugguggcacgugccuguaaucccagcuacuccagaggcugaggcaggagaaucgcuugaacccgggaggcggagguugccgugagcugagaucgcaccacugcacuccagccugggugacagagcaagacuccaucucaaaacaaaacaaacaaaauaaauguaguauaggccaggcaugguggcuuacaccuggaaucccagcacuuacaggaggcugaggcagacagaucaguugaggucaggaauucaagaccagccuggccaucauagugaaacccugucucuauagaagauacaaaaauuagcugagugugguggugugugccuguaauuccagcuaguugggaggcugaggcaggagaaucgcuugaaccugggaggcggaagcuguacugagccgagauccccccacugcacuccagccugggugacagagcaagacuccgucucaaaaauaaaauguaauauauacauuuaauauaauauuacucagccuuaaacaaagaggaaaccacgucauaggcugcaacaucaaagaacuuugaggacaucaugcugugggaaauacgucaguaacaaaaaaaacaaauacgcugcauguuccauuuauaugggguaccuagaguugucaaacucauagaaacagccaguagcaaggugacugccaggaaagaaugcuaggagagggguucagugggcacauaguuucggccaugcaagaugaaaacggucuagaggucuauuauacaaccaugugccuauaguuaacaauacuguacacuucaaaauuauuuuuucuuuuuuuuucuuuuuuuuuuuugagauggaguuucacucuuguugcccaggcuggagugcaaaggcacgaucucggcucaccacaaccuccgccucccagguucaagcgauucuccugccucagccucccuagcuggaauuacagucauguaccaugcccagcuaauuuuguauuuuuaguagagacgggguuucgcuguguuggucaggcuggucucgaacuccugaccuccggugauccgcccgccucagccucccaaagugcugggauuacaggcaugagucacuaugccaagaauuuuuuuuuuuuuuuugaaacagucucacuccuguugcccagguuggaauauagugguaugaucacggcucacugcagcguugacuuccugggcucaggugaucccacccucuuagccucccaaguagcugggacuacaggaaugcacuacaaagccagguuaaauuuuuuuuuuccguauuuuuaguagagaugguuucaucauguugcccaagcuggucuugaacuccuggguucaagugauccgcccaccuuggccucccaaagugcugggauuacaggugugagucaucaugccuggccuucaaaaucauuaagaggauaaaccuauguuauauguuuuuuacuguacauaaauauauauagugguaagccuuuccagauuucuuccaagcagaauauccauacguucccccuuacgcacuucaaguguggaaagggaaacaggaagaacggauucacuuucucccucuccaauccacauccagcccacucaccuuuaagaaggacucuauccuguuauauccacaaugcuagaggguagagucagaauaaaaaugugaaagaugucuuaauacaacaggauaagagagauaaguagacaguuuaauaucacuuauacgucuauuuuuauuuacucucaagguguguguguagaguagugugugugugugugugugugugugugugugugugcauguauguggguuuaagaaggacaaauguaucagggaggcuugucagucaaacauuaauagagaaagcuaaccgccaaccacucagcuaagucucagugaaaaacaaagauguugaaagaaaauaauaguaguuuucagugugaagagagcugggaagaggaaacagcaagugcugugggaacacauagcugggggggccugccauggguuucccagagacagugaugccugagguuagcccgguacugaggggcccaagaguguuccuggcuaugaaagagcaaacucgaaguccccaggagccuggcgcuuuugagaaucucacaggagcccagggcagcgaaagcagagugucugaucgagauuagaggugacuccagaggacggcagaggucagcgagggcuucacugccauaugaggaugcuggacuuuauccccaagggcauccaccgaguggugagcagggaagccacacgcugaacucugacuuuuaaguguugcuccagcggcagugagaagcccuagcccagguguggucaccgcaguaucagagaugggagagaagagcgccucagacaggggacagugacuccaggaaugcaaauggacagauucccauuccuggaagaaggcucaagugcuaugaagagggaacugagucauguauuagguuggcgcaaaagcaauggugguuuuucaucauuacuuuucaugguaagaacagcuauuauuuuugcaccaaacucagaauuuugaaauguuaaagugaaggcugaacuggcuuaacuuggugaccgaugggauguggagagugugggggagagggaggaggcauggaugccgcccagucuucugguuggguaaccaaguggauaaugauguccuugagggagaugaauuucugcaaaaacacaguuuguguggaaauauaaaucguugugaacaugcagagucugagauaccugcccucugcagccuuucuuucuuuguuucuuuuuugagacacaguaucgcgauguugcuaggcuggagcacaguggccugaucucggcucacugcaaccuccgccucccagguucaagcaauccccuccugccucagccuuccgaguagcugggacuagagacaugcaccacgcccagcuaauuuuuauauuguuaguagagaugggguuucacaauguuggcuaggaugguaucaaucucuugaccucaugacgauccgcccgccuuggccucccaaagugcugggauuacaggcgugagccaccgugcccagccugccugcaggcuuucuuucucccauucuugucaucucagacaacaucugguauuucuccauuguaaguccauccuauuucuccaucauauacggaaauagggccagaaagaaucuuagaaaucaugucauccccuacccuucauucuacacauaaggaaacugagaacuggcagaguuuaggagacuucaccaaggugcacaggacuguaaccccguacacacccccugacgcagagcccaugcucagguuccucccagcaccccaggaagcacguguuucuuucuugcuucucacacuugccgcugucaccaugguaaccacucuuccuggucuagaagccuagccuccugaagguacucauucaaacaugagaaaucaugggccuucuuaccaguugaggccucugacuguaacagucauagacuuaugaacaucaaaauaaucagaagcagccaggcgcgguggcucacgccuguaaucccagcacuuugggaggccgaggcaggcggaucaugaggucaggagauugagaccauccuggcuaacauagugaaacucugucucuacuaaaaaagcaaaaaauuagccaggcgugguggcaggcaccuguagucccagcuacuugggaggcugaggcaggagaauggugugaacccgggaggcggagcuuguagugagccaagauggcaccacugcacuccaaccugugggacagagcgagacuccgucucaaaaaaaaaaaauuaauaauaauaauaauaaugagaagcaguugaaaaguaguugaaguugauaucuggucaaguugcucacagaaaucuccuguuaggucauuucaguuuucauuaugauuacuuaaaaaaacaacauaaaacauugaguccauuaacuuucacgguaugauuuuuuuuuauuuuuuugagacggaguuucacucugucacccaggcuggagugcggugguacgaacucggcucacuguaaccucugcaucccggguucaagcgacucuucugccucagcucugccugaguaacuggaauugcaggugcaugcuaccacaucuggcuaauuuauauuucuuguagagacgggguuucaccauguuggccaggcuaaucuccaacuccuggccucaagugaucugccugcuuuggccucccaaagggcugggauuacaggcaugagccacugcaccuggccacacaauaugaauuuuuaaacauccaucucuaugcauaauaguuuucuauaacauuuugguuucccauaaaauuccacacaucauacauuuucauagaaaauugucauaugguuuugucacaugguuuccuguaaaauuucacucuuucagcaaauguugguaggauuugcaauuuuuuuuuuuuuuuuuuuugagauggagucucgcucucugucacccaggcuggauggagugcacuggcacuaucucggcucaaugcaagcuccaccucccagguucgcaccauucuccugccucagccuccugaguagcugggacuacaggcaccugccaccacgcccagcuaauuuucuguauuuuuaauagagacgggauuucaccggguuagccaggauagccucgaucuccugaccucgugauccgcccaccucggccucccaaagugcugggauuacaggcaugagccaccgcacccggccugcaauuguuauuaacuggguaaagaaauaaaaucugugacuuuugcccuuugagcuucuauuuuuaugaucuauuaggguaaaauggaacaugucagaaacaauguguaauaauaguuaagaaggaauuuuguuaacuauuacaaauccucaacccuacacaguuuuaaaaaaaaaugcuuaccugaggcgagaauccuuaaagguguccagauacgcaggguagcuccacccaauucuacucccuuuacaucgaagcucuacaguuugccccgccagcagacucaggguagcggcggguuucuggaagcgaccuuuauccagcacuugcaucaugauagacugcgucuuuggugcugaauuggcugagucccuguccuucauuuuaggaauuuugggcuucaccuucuuguugguagguuugauucuauucucuccugguucuuuuggacgcuuguucuugggaagguguuggccaguaacugcaaaacguaaggagagagaaaugcgcuguaguaaugacauuuuuggaauauuugaggccaauaacuuuuuuuuuuuuuugagacagauucuuacucuauugcccagguuggagggcaguggcauaaucucagcucacugcaaccuccaccucccagguucaagugauucucuugccugagcacccugaguagcugagauuacaggugcccgccgccacacccaacucauuuuuguauuuuuaguagagacauggagacagggucucagcacguuggucaggcuggucucgaaguccugaccucaggugauccaccugccuuggccucccaaagugcugggauuacaggagugagccaccaugcccagcccucauagcuuuuagguaacucuagagaagauaacuuuuuaauccuccccuccucauaugucaauauuguuuucaguaaaagucauguaauuaucaucuuuugauuaauuuuaaaacauuaaaaaauauuucagcuccaaagauauuauucaaauucagcaaaacaguucauguaugagcuaaaauuugcccuuagaaaacaaaaauauuacugccuguaguucacaccgucucauagucuccaagcagucacacaaaacagcagaacugaagccauucaaggcuguuuguuuacuuugcagucuauauguugucaccauucauuuugauucuacuguuuaaacacagaaaucuguagcuccacagagacuggggacacaaacugugcugaaagugcacgcaaaauauuuuguguuuaacguuagaaacggaaucucacucugucacccaggcuggaaugcaauggcaugauccuagcucacuguagccuugaacuccugggcucaagugauccuccugccucagccuccugaguagcuaggccuacacauaugugagaccaugcugagcuaauuuuuuuuuuuuaaagauggggccuugcuauguugcccaagcuggucucaaacuccuggccucaagcaacccucccacguaggccucccaaagugcugcaauuauaggugugagccacucugcccagccaagauuuugaaccacagugaacuuucucucaaaacaaaugguaaagcagacauuacauuugucaggggcuggcgaugucuagguagaauaaaaugcuuauuauuaaagaguaaauauuauguguauacuaaucugaagcuuacauauaaauuaucaaaacucaacuguaacuguagcaacgauuuagaauuucaccaacaaaaugucucuggggaaggaguauuuuaucaccaacauuguugagaguugcuggcaaauagugauaauaaaaagcuaacugacuuuaaguugcuuuuguugucauuuuugccuucucuauaaguaaggcacccuuauugccugcauccagggaagagugcccccacuguucugccuguggugggccaccggacucuaaaaaucucagcuaagccccuugcagccacacaguuguguccacucaacaagaaugaauaggggacuguaggccaggugugguggcucaugccuguaaucccagcauuuugggaggccaacgcagguggaucaguugaggucagaaguuugagaccagccugggcaacauggcgaaaccccaucucuacuaaaaauacaaaauuagccaggcaugguggcgcaugccuguaaucccagcuaccacucgggaggcugaggcacaagaacugcuugaacccgggaggcggagguuacagugagccgagaucacaccacugcacuccaaugccuggagacugagacugagaccgagacuugagcccacaaguccgaguuuaugaugagcuaugauuguaccacugcacugcagucugggugacagagcaagacucucucucaaaaaaagaaagaaagaaagaaagaaaagcccaccauuaucaugcccaagaaaucugugccccauaaauacuuuaaugccugugaaauuaaugaaccucuggauuaaggucuaauuugguauucuguguaucauguaacaggaauucaagcuaccagaaaugacaauaaccaucuguaaauccuauggaauuuagacaaacagagcuacuugucugauccuucuaagcuaucacaucuuguguaucuauguuacucaggaacaugagauuaucugauuuuggagauuaugcauccaaauauuugcuauuaucuaugcaaaauaauuugaccuuuugaccaaauagccccaccagcugaucuaacuguauagcugguccagcugccugaccacagaauuggccugugguuugauggcaaugaugcaaagcuaaaggagccagccuaguguccccacagauacccagacgguauuggaauugagugacucccaaaucccaugucuaacuguuuaaaagaauaugacucuucagccuaacuaugucaauugguuauuuuucaaagacuuaaaaaauacaagaauucauacuauaagugaacguccauuaccauugaauuuuugagacuauugcaucguauaauuuauagagaaauagguggcaaaauucaagaaccauuaaauaucauuacuagcuucagguccaggccugccacuuacuggcugugugaccuugggaagcuacuugcccucuucuguuucaguuuucucaucuauaaauugagaaugauaugguaauaacuaccucauaauaacuguaauaauuacugugggaguuaaaugaguuaauaugucaaaacugcugaaauuagcaucugaccuacaguaagugauugcuagcuaagugcuauuuguuuuuuuaugguugucacaugagaucucuaugaugaacuugugguggaaacaaagcagauauuagucucuuuaauguauagaugccaaguaguucacuccaggucaucaagaagguagugaaaaaacagacccucugacuccaagucuagagcuuucucuggcucaugccauugccucuccauccacuuagagauuagcauauuguugcuuuuucacuuuauuugcacaaaucucaugcaccaugagauucuuuguuugaugugacauggaguuccaagccaaacagaaccugaugcuggggaugacagccuccucuuccuggaagagcuggaggugcuuuuccaaggcacacacuggauccccucggugaggagauguuggucaaaaccucaucuccagcugggugcagcggcuuaugccuauaaucccagcacucugagaggccaaggaagguggaucacuugaggccaggaguucaagaccagccuggccaacauaguaaaaccucaucucuuccaaaaaauacaaaaaaguagccaggcauggcggcacacgccuguagucccagcuacuugggaggcugaggcaugagaaucguuugauccugggacacggagguugcagugagcugagaucgcaccacugcacuccagccugggcaacagagugagacucugucucaaaaaaaagaaaaaacagacaaaaaccccaaaacccuuauauccaaaauaaauaaacaaauguuacaaagcaagaaggaagcaggaaaaaggaccaugauuauucaucaucaacugagaaucacaaucaaaucuuauucaucaaaagugaccuauuagccuaauucaauagaacuguguuggaggagaaaauaaauucauuagaagaaucauugacugcagccuggaugagauuucuuguuaagcacagucauuaauaucaaagcgcuagagcuguuggguuuucuccucccugaugggcaguaaaggggaaaggccaucccuaaaaguagcuccucaguuaaccacaccauacauucuucugagccacucaguugcuucccaauuaguuauauacacugagagaugccacucucauuuuuccauuuuucaugaaacaccccacaggaacacacacacuuuuccaagaacaaagcugagaaggugggaaagcgauacuauggagaggaaaauguagcaagauguagcaagcccuuccuuucucucuuccuuucgagaaccccacuccaaaaaacccaccuacugucagagauucgaaccagagagacuccaucuugaauaggggcuggguaaaauaaggcugagaaccacugggcagcauucccaggagguaaaggcauucgucacaggaugagacaggagguuggcucaagauacaggucacagacaccuugcugauaaaacagguugugguaaagaaucuggccaaaucccaccaaaaccaagauggccacgaacgugaccucuagucauccucacugaucauuauaugcuaauuauaaugcauuagcaugcuagaagacacucccacaagcgccaugaguguuuacaaaugccaugguaacaucaggaagucauccuauauggucuaaaaaggagaggaacccucaguuccaggaauuucccgucccuuucccggaaaacucaugaauaauccaccccuuguuuagcauauaaucaagaaguaaccguaaguauaagcagcugagcaguccaugccgcugcucugccuaugaagaagccauucuuuuauuccuuuacuuucuuaauagauuugcuuucacuuuacuucuauggacucacuccgaauucuuucuuacacgagauccaagaacuuuuucuugcggucuggaucaggaccccuuuccgguaacacuaccacuguuuaaaguaucuuuaaaaaaaaaaaaaaagcaguuucugagaauuagauccuucaaugccaggauaaaggccucaaucugaaguauuuuccacaacaccuguuagaauacaguugaugacgcucuucuugaaaaacucgauucacauggcucgcaggacccugugcugccuugguuuuccuccugugucacugacaacucuucagucuguggcagcucuuccucauuuuccugaccugccugaucacuccucucuaacuacucuucacucucuaagugaccucacacaaucccgugaccccugcagcauuuauaugcugaaagcugcccuagcuccuguccugaccccgccucuacacuccagaucuaaauauccuguugcuuauucagcaucgccacuugaaagacuaguaggcaugucaaaguuagcaucuccaaaauuuagcaucucaaauuuagcaugucugaccucugaaugccccuucagacaugcuccuuccugaugcucccuuuaucagcaaaugacaauugcucaggacaaaaaccuccaagucgcacuuguuuuaaauuuuccucuccuaagccacauccaauccagcaacaaauucuuuugacuucaucuugaaaacagacccugaacucagccucuuuuccuuccauccacugauaccagccugggccaagccacuuaccauccagacauuuauacuaucuccuaagcagccccuggcuuccacuguaucacuccuucggccgucuauguggcuauaaagggauagcugaggcugaaucauuuaugcaggaaagagguuuacucagcucacaguucugcuggccagaagauucaagacugggcaucuggugagggccucaggcugcuuccacugguggcacaggugaaggagaauagguauaugcagagaucacauggagagagaagaagcaagagagagagagaggggaggugcaagccuccuuuuaaccagcucuuacaugaauuaguggagcaagaacucacgcuauuaguucuauuaccuccaggagggcaacaagccauucaugagggguccacccccacgacucaaacaccucccauuaggccccaccaccaacacuggugaucaaauuucaacaugagguuaggaggaggucaaauauccaaaucauagcauugcaccucuggccccccaaaacucaugucuuucaaauacugcaaauuacaagcauccuuucccaauaguccccgaaaucuuaacuuguuccagcaucaacucaaaaguccaaagucucaucugagcuugaggcaaguuccuuacagcugugagccuggaaaaucaaaaacaagccuucgcccuccccaccccucuaacuuggcugggugaagcccacauggcugaucugacagguuggaguugaaugucuguuuguuuuccaaggugagggugcauacugcugguggcucucuaauucugggauccccacaugagcccuguucccauggcuccccuaggcagugcccugguagggacucucuguguuaguucugccccuguagcaggcuucugcucgcacacucaggcuuucugauacauccucugaaaucuagguggaagcuaagccuccaucacucuugcauucugggaauaugcagacuugacaacauguggaagccuccaagguuuauuuauaacuugugcccucuggagcaaccucucuguucugcuuauuggccucuucugcucuuauucgcccaucuggaaccacaccugggaccuuuuaagugaaggcuagagcuggugcaccugagauaggggcaguagcaucccgagguggugcacggcagaagagcagcagggccugccccccaaaaccauucuauucuccugagucucugggccugggaugggaggggcuccucaaagauuuccaaaauggcuauaaggccuuucucuuauuuucuuagcuacuagcaugauucaagcagucucucaacugugcccuuggauucuuuucccaaaaugcucuuucauucucugccacauggccaggcuucagauuuuccaaacuuuuacucucugcuucccuuuucauaauaaauucuaccuuuaggucauuccuuugcugcuguaauugaucuugagccuaaguuuuuuuuuuuuuuuuuuuugagacagagucucacucugucaccaggcugcaguacaguggccugaucucagcucacugcaaucuccucuucccgaguucaagcgacuccccugccucagccucccaaguagcugggacuacaggugcgcaccacgacaucaggcuaacuucuuguauuguaauagagacaggguuucaccauguugcccaggcuggucucgaucuccugaccucaugauccgccugccucccaaagugcugggauuacaggcgugagccacccugcccggcugauccuaagcuuuuaaacccagccacacccaccacuacuugagcacuuugcugauuaaaaauuucuucuuuaggauacccuaggacaucacucuuaaguguggccuuccaaaaucccuagggcauggacacaaugcagccaaguucuuugcuaaggccuaacaagggugacuuuucuccagcucccaauaaguuaucuguuuccauuucagaccuugucagcaugaacuuuacugucuauauuucuaucaacaguuuagucacaacuauauaaccaaucucuaagaaauuccaaacuuucccuccucuugcuguuuucuucugagcccuccaaacucuuccgauucucugcccaguacccaguuccaaagcugcuuccacacuuucagguaucuuuauagcaauaucccacuccuugguaccaauuuucuguguuaguucauuucgcauugcuauagaggaauacguagggcuggguuguuuauaaagaaaagagguuuauuuggcucaucguucugcaggcuguacaagaagcauggaaccaacaucugcuuccaaugaaggccucagacugcuuccacucagggcagagggcaacgauaacuagcagugcagagaucacauggugcggugggaggaggagggaccagacucucuuuaacaagcaguucuugcuggaaauaauacagaauccacacauccccaagggaaggcauuaaucucuucaugaaggaucuacccccaaggcccaaacaccucccaugaggcccuaccucccaccaccaccaccacaugggggaucaaaauucaacauaagauguggugggggcaaaccauagcaccuaccuuugaaaacauaaaucaaauuauggguacuucuucguucagaagccuccagugacuuucaucucaucuagaagccagcccuaaaucuucccaugcccuacaaggcuuggccagcucccgucccacgcaucacagccacagccacacuggcaaccgguacaagcccaucuugaagcuauugccuuuguggugccccuggagugcacagcuuugcugucagcuaccuccgggguuugcuuccuuguuucaggcaggcuuauggcuauccauucaaacggcauccucacaccccgccucaguccucuccaugucucacccugucuuacugguugaauuguguccccuaaaaagauaugcugaaguccuaacucccagguaucugugaauguaaccucauugaggaauggagucuuugcaaauguaaucaaguuagcaugaggucauuaggguaggcucuccuccaauaggacugauguucuuaugaggagacacacacacacacacguaugaaaaugccauguaaagacagacacggggagaagauggucacauggcaacagaggcagagauuggagugauguggccacaagcuaaaaaaaaugccaagggguugcugaccacaaccagaagcuaguggaggcagggaaggauucuacccgcaucuuagaagcuguguggugcugcugacacugacuuuggacuacaagccucuggacugugagcaaacaaacuucugcgguuuuaaagccucccauuccgugguacuuuguuauggcagcccuaggaaccuaauagacccugauucaugauucucgaugccacuuaccacuuccuuaaauuguaucuuuacuucuuuaucuuuccucucccuucauugagcaccacaaagaaaggguuuuaaaaccuugucuagguuugaaaaccaucaguccucugaccaccagaucucucucucuugcccucaaacuuuucucuuucuguguuuuaaggaucagaaaugguuuuguaugucaaacaugccagccaagauccuaaaugcuucaaagcauucauuaugugcauucauaaacaauaaggaacuuuagaauucuuuuuuucauuaaaauauuucuguacuaauuuuuacucuuuuuuuuucucaaaaauaaacgaagacacgaaagugucaaaggcucuugguuagagaauccucgucauugugucucuguccuuaccuucuuagagaucuggcuauauugcucucagacaauaaugaaugucuguaguccuccaagaaagaaaccccuuucaccagaugcaaaauaaacccagguuacugaagaccagauuagcauggaucaaggaucucauguuauucaacagaacucguugcacaaaucaauauuaacacuucaguguuugcuccugacauucaauaaaaauauguagguaaucaaaagucaggaaauauuugugauuuuauacuuuucaaugugaaaauagaagcacccuauuaauaaacucgguggcauguauuccauauaaaugcugaaaaucaggugcuaugauugacaucucaacguggaaucuuggauuauuuauuaccuguuuucaucccucaguuucaugccaugaaguauuaugugccuuuccagcuccccaucuucaugaggagaaagaacauuacuuccaaaaauuuaaagcauuuugucauugggagcagccagcuucauugggucacaggccagauguucacccccauacacacuugcagggaagucuuuuccucuuagaaggcugucuuuggcuaguugugguggcuagcacaaguggaagucgcagugagcuaagauugugccacugcacuccaccugggugacauagcaagacuccaucucaauaauaauaauaauaauaauaauaauaacaauaauaauaaaauaauaauaaagacugucuuuuagaugugaucagaaaaacuaaaaggcagugaaacaaguugagucauggaccuugugucuguaauuugugcuuugggauggccuugaaggcaggauauucccaaccugccaaucugagaccagcacuggaagggccuccuguguaauccacucuccuuaguagcuccuggccacaacucacaacacaacucaaaaccaaaaaccauucuuaauagguuuagccaaacgguuacauaacuuaaugaagcacuguguguucacuauuguauccauaaauaguccauacauuauagauaugugugcuuuuauuuuuaucuuuauuuucuugagauggagucucacuuugucgcccagcuggagugcaguggugcgaucucggcucacugcaaccucugccucccagguucaagcaguucucugccucacccucccaaguagcugggauuacacgugcccaccaccacgcccggcuaauuuuuauauuuuuaguagagacgggguuucaccaucuuggccaggcuggucuugaacuccugaccuugugauccaccugccuuggccucccaaagugcugggauuacaggcaugagccacugugcccggccagauguguguacuuuuauaaacaaaaucuucgugcuauuaucaccuaaaauuuaugaacuauuucuuacauucagucuguauuccacuuucuccaauugucucauaaaugcuuauuguuuguauggauuacacuuaaagaaaggguaaauuuagucagauguuuguaauaaacucacaugggcugggugagauccaggaggcagaauggaagucaauuucugagccucuaagacuggcaaguuggguauaaacaaaggaauggcugauuugaaauuauuuugccuggccaucuccugcccuauucaaaaaaugauacuacaaauuacauuucugccuuuucagcgguugcacacaagggccugccaggagcauuuuaauauugcauuuuacaaacugaacucauggcaacuucucucugggcagaguuaaguguuacucucccaguagaagcucugccuacguuuuauuaagcaaagcucuaggcugaaggacccucaugcucaacuucaaguaccacgacuaucuuggauuuugcaaacuacaaugcgguauuuuuuuggcaaauguaguuuccuaggaaagaaaggaacuggucaggaugaacgaguggauaaaaaugugagccaggucgagcuggcuccagcaugaaguugcauaacagcaaaagcuacuuuuccacuaaaucuaagcaaaaauuguguuguagcccaggaauuucaagagaggguugaggacaccaggaggcacccagaugaaacauguacuguacaaauaacacccauggagugaauagagcaaacaaaacauuuaaaugcuaacaauaauauauaauacacaccacaguaauacacacacccagacacacagaaaaauaacaccagacccuguggucacggguguacacgacaggguggacccaggacagguacacauucaaaaacgcgcagcggucauggucccauaagcuguaccaaaaaaaugcauuuucuucaccauuucccauccaauuagauaaauauaauaagccgugggcuuuugauucguuuugaaguuucauacacugacauuuuuguucgaagaucuaggcagaucuugcaggauucaagcaaaaggugguagacgaaaacacgcccagaacugcgaggggagggggaggucaccuggaacucugcaaccgaaucagcgauugccgagcuuagguggcacucgcucucagcagcagaggucccagccacgccgcugggagguggaagcgauccgaggcucccgccccaccucccagaccgacacguugacacugggggcuggaccaggcgcuggcuggggaugcuugguucgcccggagauggggacuuggagagguccuggugggcuccuaagggucgggguagcugccaccaccccuagagggcucuccgggcaggcaaagagugggaggaaaggagaccccaccaggagggggcaggugcaccgggcaggcaguggcgcgggggcugagccaccgagggccgaacguuagaccaagagcuggcaggagggcggcgggggcuucgggucccggcuaaagucagggcacaagcuagguggccccgcgcccagagucacucaccauccuccagcgcuucgugcaccagcagaagaccaagcagcagccagaccuucaucucgggaaccucggaccucggagcgcaggagcgcggcggcugcgcggggcggggacgcaggggaggcggcgggcgaggggcgggcuccugggacgccgaagcgggaggauucgguuucuucaggaggaacaagguuugggggaaaaaguuggggaauuuuuuuuuuuuuuaguucucuguguaaugugacuucuccugcccccuggcggagccgcggugcgcagcacuucuucccagcgcggggaggaaaggcuaagcgugaaauguacauuacaacagccauuccuugaauuucuccaacgcuuggcguuuucaccaagguuaucaaguucaagaaggaucagcgggugcugauggggucacuuuuaaccacgauuguccaaauguuaccagcgcccgccccaccuccucaggcagaaccugagugcucuguaaaaagugcuuccuaaauuauuucuguucauuccauuucucucccccacaugcacucacucacaggaccguugccccggguucuugcugcuccucugugucuggccagaguuggucuccgcacccagcccuguaacugcuggugggggugggaggacggguucauuacaggaauaacguggaaaaugagacugugcagacaacccgggccucugguggugaggcaggagaacagggaauuaggguaagcacgggcuaggguaugagcaggagaacagcaggugcagccaguucgcagaagcaaaagaucagcaggugcagacaguucuaggcaugauuaggcggcacacaggccacauccucgcuccucugauaacaaggcagaagu

SEQ ID NO: 193024 - RNA, 76779 nt, Homo sapiens
ucuuuggagcacuuguuaauccguuaugauuuauuagcuguacagcaguagauccuccuccccagcuuucaaccccauuacauauuuuauuacaggucucauguuggcguccuaaaauaaugaaaaauaucacacaguacagcuaaguacaaaaugcaucaaccuagagucugauagcuaacugauggcucucuuaaaagcaauacacagaagaaaaaaguguuugaaaucaguaagacugaggcucucuaaaaaacacauuuuuaaacaugugacaguucaugugcaagaaucacuuuuuaguugguuuugcuucacauuauuuuauuuuuugaagauccaagguuuaaauuacugaccuagugaaauuuucuggcccagcuuauaagggcugcugugaaccacucauaaucacccuucugccuuaacagaagauuuauaaaacacaacaaucagcuacaaacagggcaaagaaaaugucgaugggaaaucauaacugaaaguuaauuauacaagguucaaaugcuggcuccgugggcuggaaaucaugaucugccacgugcauguccgucacuggugggcaguggucugggugccauucugcuacaugauugugauccaauuccuugucaacauuuacacacuacagagucugugguaacuuaauuugcaaguaauuaaaaugcuggguuuucuuacacugcacuucuuuucaaccucuuaauuaauggaaaagauuaaaauguaaaaaaaguuauuuacaagcuugaccauaccagaaacuuugccaagaaagaggcaaagcuuucaggacagaaccugaucguagcaugccauacuacuggugugcagcugacuccaagcaaagggagucagggaaaagcaaaagcaaaaaacaguuuaaaacucuaaguccuucccaaguaugcauuuacaauuaaaaacucucuugggaagaagaccauagaacucugggaagccugguggccauucuggagugguuuaccacauggagggaggggucaaugucuccguuuccaucuaggaaaacgaguuaguugucaacacuguccucagcacuucacaguaaacccucagggacucagaacauuccaugauuugcuaacaucagacagcaaguucuaguuaaaucacauuuuuuucuaacaucauccuugaaguuuucguucucgguauguuugguaaaaugaugcuuuucccaaagccaaaaaaagaaagaagggagaaaaauuaagaugcgggccguuuaaacacagcccagagaaguccuggcgacgcacaaggcuccgccaucaccgguccaucaugcugaggaucaucucgggcgugaggucuccguugggggcaucuguggcagcuggcugggccuccucuuccucucccucugcgggcucagcaucuggcucuuuuuuuacuucaacuauaauguucucaauugcaccuguauucuggucuucaaccugaaugauagcuguugcuggcaaagaagagcacagacagaacaaaugguccauuaaagccccaagaaucacaagggucuuuuagacugacagcgaacgggaugucagcaaugcaggacagccuuauuagauagcgguccagagacagucaauuuauuuuuuauuuuauuuuuugagacggagucuugcucuaugaccaggcuggagugcacgggcaugaucucagcucacugcaaccucugccccccggguuaaagcaauucuccugccucagccuccugaguagaugggacuacaggugcccaccccuacgccuggcuaauuuuuguauuuuuagcagagaugggguuucaccauguugaccaggcugguauggaacuacugaccucaggugauccucccgccuuggccccccaaagugcugggaucacaggcaugagccaccgccugacccugaguuucuuagaaggggcaaucucagugcagaaacugcuuucccucuccaaccuuuacgauuuggcucuuuuauauucauuaccgcauccauucugccagcugacugugacuuugguuguuuuucaaaacccgcccacauuaacaguacccaucuugcagaacacaaguacccuucuacucuggacuucuucuugaaauguaacaggccucuaaagacuuccucagauguuccucaguaaaaacuccuaaaaagccauuuccugagaguuuguucucgacaugcccuuaacuuguucucauggcuuaguucccacauccccaaagaacaaggacccaucuggcucccccacaugcucggagaagacgccagccuccagagcagagaugaacaacuuacgcugguucuguuugggcugguugguucugccagggggucguccucuccgcuucuuggcgggugguggggcuggggucacaggcugaggcucuggcucagguucaauuucuacggcaggcuccuccucauccucauugucguccagaucugguucagcauuuucuuuucaugaaaucaggaagcacaggugguggggcaaggagaagggugguggaagaugaaagaaaacaauuauauauuauuugaagucuuguuuuauaaauauauauauauauauauauacacuuucuuucuuuuuuuuuuuuugagacagucucacucuauugcccaggcuggagugcaguggcgcgaucucggcucacugcaaucucugccucccagauucaagcaauucucguggcucagccuccugaguggccgggacuacaggcacgcaccaccaugcccagguaauuuuuuuuuccuucuuuuuuuuuuuuugagacagagucucacucugucgcccaggcuggaaugcagcggcacgaucucagcucacugcaaccucugcaaccuggguuuaauucuccugucucagccuccugaguagcugugacuacaggcauacgccaccacaccuggcugauuuuuguauuuuuaguagagaugggguuucaccauauuggucaggcuggucuugaauuccugaccucaggugauccaccugccucggccucccaaugugcugggauuacaggcaugagccaacgugcccagccaauccagauaaucuuuguauuuuuuguagagaugggguuucgccauguuggccaggcuggucucaaacuccugaccucaggcaaucugccugcuucggccucccaaagugcugggauuacaggugugagccagcaugcucagccaauuauuaagaaaaaucaauuuaaggcugggcacggugguucacacuuguaaucccagcacguugggaggcugagguuggaggaucacucauguucaggaguucaagaccagcuuggguaacauagugagaccuuaucucuacaagaaauaagaaacuggcagcugggcgugguggcucacaccuguaaucccaguacuuugggaggcugagguggguguaucaccugagguugggaguuugagaccagccuguccaacauggagaaacccugacucuacuaaaaauauaaaauuagcugggcgugguggcgcauaccuguaaucccagcuacucgggaggcugaggcagaagaaucacuugaaccugggaggcggagguugcggugagcugagauccgccacugcacuccagccugggccacaagagugaaacucugucuccagagaaaaacaaacaaacaaacaaaaaacaaaaacgaaauugacucggugugauggcucaugccuguaaucccagcacuuugggagggcaaggugggcagcucacuugaggucaagaguucgagaccagccuggcaaauauggugaaaccccgucucuacuuuaaaaaaaacaaaaaaacaaaagguggccaggcaugguggcucacaccuguaaucccagcacuuugggaggcugaggcggguggaucacaaggucaggagaucgagaccauccucgucaacauggugaaacccugucucuacuaaaauacaaaaaauuagccgggugugaugaugcaugccuguagucccagcuacucgggaggcugaggcaguggaaucacuugaacccaggaggcagagguugcagugagccaagauugcgccacugcacuccagccuggcaacagagcaagacuccgucucaaaaaaacaaacaaacaaacaaaaacaaaaacaaaauuuacccagcgcagugacucaugccuguaaucccagcacuuugggagguugaggcagguggaucaccugagguuaggaguucgagacaagccuggccaacaugguaaaaccccgucucuacuaaaaauacaaaaauuagcuaggugugguggcggcaccuguaaucccagcuacucaggaggcugaggcagaagaauugcuugaacccgagagguggagguugcagugagcugagaucacgccauugcacuccagccugggcaacagagugagauuccgucucaaggaaaaaaaauaagaaaaaaaaaaaaaggaagaaauuagcaggacacgguggugugugucuguagucccagcuacucaagagacggaggcaagaggccugcuuaagccagggagguagaggcugcagcgugcugugauuucaccacuguauucagccugggugauacagugagauccuguguaaaaaaaaaaaaaaaaaaaaagcccauuuaggcugggcaugguggcucacgccuguaaucccagcacuuuaggaggccgagguggguggaucaccugaagucaggacuuugagaccagccaggccaacauggugaaaccccaucucuacuaaaaauacaaaaauuagccagcugugauggcgggcaccuguaauccuagcuacuuaggaggcugagguaugagaaucacuugaaccugggaggcggagguugcagugagcugagaucacuccacuacacuccagccugggugacagaguaagacuuugucugggaaaaacaaacaaauaacaacaaaaauaaauaaaaacuaaaaacaaaacaaaagcccauuuaaaaaugcuuuuaggggagcagggugugagguuccaaaaaauaauaaauaaaaaugcuuuugcuggaauuuuugcuaucaggauuaauauaauaaacagguauuacagcagaaugaagcaaaucgacuugaauacuauuauucacauuuuaugugggauuggcuauuacuuuuuccuuuuagcuuuagacccuuuuuugacucaacacaauaccgaauuucaaauucucaugaucccccuaccuacuauaccaggauaaagcaggacacuaagccggaaauggacccuuggagaugugguucugcucaucucuaagugggcaggaaggguaagagugagugagugagagugugugugugugugugugugugugugugugugucaggggacaagacggaaauucuuuuucuuuuuuuuugaggcggggucuuguucugucacccaggcuggagugcacuggugcggucauagcucacugcagcuucuaacuccugaccucccaaaguguuaggauuacaggcuucauccaucacgccuggccagaaauucuuacgcauugugagguccuauuuacuaagguaaguagcaagaguucuuuugaaacuauuauugauucucuuuuaaggucaaguuuuuggacuuaauucccagcuguacuagacccaaugugucauuuccaacccucuugcucuccucccuaaugccacaauuguccauucgugguaaaauaagugguacaugaaagugaggaaacuauuguauaaagaauacugacgaggagccaggcaacaaggcugagucucagaucucuuacuagguacgugaccugggacaucugaccagcugagacucaguuucccugaguaauuucuguaacauucucacuccauuuaauagugacaccuggggaucaacaggacucacggaacucauuuaauccugcuccguaaccuauagucuaccacaaacacagcuuuuacuuauagcaaacaucacaauuuaaaaauucaccauuuuccacuuaggcuucaguacuucauugaaugaggguguuacccucauuuuauagaaaaagugagaaacuaagugacugcaaugcacagcuaagucacagcagguagaauucaaaccucugcccucagucuggggcuguucuggcgcccacaucugcaggcagccaaagagcuuuuguuaucccucccccauggcugcggcacaaaauguacacugccugccuuccucuagaaagcacggguuauuaacaugcacucucuuucucuggaacaaaauguuuaaauuuagagaucuguggguaaacuccugaucuuccagauaaaaugccuuauuucucaagugacugaaauccuaagugaaaacguggggaauauauagauagguggcagugugucaagaacgagagaugcuucccugcugaacuucuucaagcccucuauugccuaaguuggcccaaugccuagaaaacuaaacaaguucagucagaauugggggaaaagcacacaaaagcaggcuaacaggaucaaaggcuuauuggcuuggugguauuucagcaaaaagccuugaaaacagcaguagaccaucugcuggucaaucucuguagacagccgacaggcagaacuucugggucaggacaaguaagacugcauggccaacaguggcauggagcccaggcugacgucccuuuucugggggagauaaagagucacuagguauaaggccuggaaccaaauuccaugcucuacuaaccagcagcagacagaacacagaacuguagaaaucuaucagaagcuaucaauaaucucuuuugacuaaagaugcuucugguuacauacaauuagggaaagaagcuggucuuccuggagaugaaccacagaagugaacaaggcaguaucaggagaaagcaggacauaggacagagucuggcagcaggcggcuuugcaacuaagaacaacuauagggauccccaagguuaagauuaucugaucacugguaauaucugggagucuccuaacauuucugaaaacccccaacaguucagugcaauaauuuuuuucccuuuuuuuuuuuuuuuggagacagggucucgcucuguuacccaggcuggagugcagugacacuaucucaguucacugcagcucaaccuacugggcucaagccauccucccaccucagccucccagguagcugggaccgcaggcgcaggccacaacccccugcugauuuuuguauuuuuuuguagauaacaggguuuugccauguuccccaggcuggucuugaacuccugagcuaaggugaucugccugccuuggccuaccgaagugcugggauuacaggcgugagccaccaugaccagcugcaaauugacaucuuaaaggaggcauacacuuaacacccagugacugaagaagaugcuacuuaaaacggauacuccauuuaaaaaaaggaaaaaaaaaagggggggggggugggggggaccuuguuacagauccaaacauaaacagcuuagugcuuucaugagaaaguuuuacaauaaaacccauaaaguagcugggugcaguggcucaugccuauaaucccagcacauugggaggucgaggcaggaggaucacuugagcccaggaguuacgagaccagccugagccacacagugggaccccaucucuauuuaaaaacaaaaaaacagccgggcacaguggcucacaucuguaaucccagcacuuugggaggccgaggcggauggaucaccugaggucagggguucuggaccagccuggccaacauggugaaacccuaucucuacuaaaaauacaaaaacuaauagggugugguggggcaugccuguaaucccagcuaccugggaagcugagcaggaaaaucgcuugaacccagaagguggagguugcagugagcagagaucgcacuacugcacuccagccugggcaacaagagggagacacugucucaaaaaaaaaacaaaaaacaaaaaaaaaacaaacaaagaacaaaaaaagcccaauaaagucacuaaaguucuccaauauguuccuucuucaaaaaucucaaccccuccccacuauuucuacugacaaccagugcaaaacacaauaugaagaaucccuagacuaucaggcaucaucuauaaucucuccaguuuaauggugcuucugggaaguccauuuccuaaaaccaaacucucuaccaccuuuuccauccauaccuuaagucuuuaguuacagaggugccuucccaccuggaugccagcaaccuagauauccacacuacagaaucuaacacucugaacauguuuguguaauuaaauguggccuccaaguuaccaagacucuuguuccuccacccucuuugugaggcuuggcacuuuuuguuuuuuuuggagacaaggucucacuucgaccaccagacuggaaggcaguggcgugaucacagcucacugcagccucaauuucccgggcucaggugauucucccaccucagccucucgaguagcugggacuaucggcauguaccaccacaccuggcuaauuuuuaaauuuuuuguagagacaagguuuugccauguuccccaggcuggucucgaacuccugaccucaagugaucugcccaucuuugucucccaaagugcugggauuacaggcaugagccacugugcccgaccgaggcuuggcacuucuaagcacaaccuccugccuggguuucaugacuagagaggcaaaaaacacuccaaagaguaccugugguaggaaaauaggcaagauuuuaaacuuuaaauggagagauuaagguaggaagagaaaggcugaccuucacugacuugaucagcaccucucaagguuaggcugacacaggcagucaaaccauaagugaagaugcuuaaacaaccuucuucauguccauuagauucacugcucuuaucuagaccagcuuccuaaauguaaaaguuaagaacauaggaaaagaaacucugcuggccuuagaauaucacaaauuugaauaaacugaauaaaaauauuaauuuugcuuuaacucaagauuacguauaaggcauuaauaauggccgggcgcaguggcucacaccuguaaucccagcacuuugggaggcugaggagggcggaucaugaggugaggagaucgagaccauucuggcuaacacggugaaaccccgucucuacuaaaaaauacaaaaaaauuagccaggccugguggugggcgccuguagucacagcuacucgggaggcugaggcaggagaauggcgugaacccgggaggcugagcuugcagugagccgagaucgcgccagugcacuccagccugggcgacagagcgagacuccgucucaaaaaaaaaaaaaaaaaaaaaaaaaaaaaaaaaaaaaaaaaaaaaagggcauuaaugagcggaaugccacgaagaaaaaagaaaauaugccccagaaaaacacuaacugcuguuguaaauagacguuaggagaugagaaguuuaaagaaaggaagagugugugcccgccucuauaucccagcauauccauacauaaacacacuggaaacugggcuccaaagccugccauaguaagcaaaucaaggaacaagucacuuaccacugucagaggaaucuucuuucuuagagcgcaucuuucuuuuucuuccacguuuacucuucuucguuucuccuccauuuucccccucuacgccaucugggccagcacaauuaucagcaugucuugccaugguauucuaacaaaaagaacaaaauccucuuucacaccacuaaaaaagcuaagaucagauuggaaguuauuuacuuuaauaaaauccauauuaagccuaaaaauucuaguaucugcuaaguguguccugaacacgcugucucugcucaggggaaauggauaaggcuggguucucuaaggggaggcucagcagccugcagacagagacgggggaggaucagaccagcucuuaguucugucaagaucuaacagagcccccaagagaagacccagaacaggcuacagcuagcuaagggugggguaggguggggugcagguuucaauccaccuaaggaaauuuuuuuuuuuuuuuugagacggagucuugcucuuucgcccaggcuggagugcaguggugccaucucggaucacugcaagcucugccucccggguacacgccauccuccugccucagccuccugggaguacaggggcccgccaccgcacccagcuaauuuuuuguauuuuuaguagagacgguguuucaccauguuagccaggauggucucgaucuccugaccucgugauccacccaccuuggccucccaaagugcugggauuacaggcgcgagccaccgcgccuggccaggaaauuucuuuaugcaaucaaucuauucaaagauacuguguuccccaucaguggaaggguucacacauggauagaaacaucaagauggggaugacuaacccuuuccaaacaauggagcaucucuguuuauaaccucagugaaaaaaacuaccaugcucugcagaggaagaccaaaaauccaauauucaguaucauaacaggcaaagugaaguucugacccuuacccgacguguaaauguuuucccacacuuagaacagacaaaagccgcagggacgaaguuggggucgugauagcgcuugaagugcaugucgagaagcugcuucuggcggaaggucuuaucgcaguggcugcaggcguaaggcuucuccccggugugggugcgcuugugcaugaucaugugccucuccugaaacggcauagggggaaaggccucagagccugcucauggggcuacugccccagcugccaccugcaugcauguggccaacagguauuucucacccaagcuaggucuagacuccacacggcuuguugagaugauaaagcuauauauuuagagacagggucuugcucuguugcaaagucuggagagcaguggugugaucauggcuuacugcagcuucaaaaugggaccauagguaugagccaccaugccuggcuaauuuuuuuuguuuuuuuuuugagacggagucucgcucuaucgcccaggauggagugcaguggcgcgaucuuggcucgcugcaaccuccaccucccggauucaagcaauucuccugccucagccucuugaguagcugcgauuacaggugccugccaccacacccagcugacuuuuuuuuuuuuuuuuuuuuuugagauggagucucacucugucgcccaggcuggagugcaguggcgcaaucucggcucacuggguucaugccauucaccugccucagccuccggaguagcugggacuacaggcacccaccaccacgcccagcugauuuuuuguacagacgggguuucacuguguuagcuaggauggucuugaucuccugaccuugugauccaccugccucggccucccaaagugcugggauuacaggcgugagccaccgcgcccggccgaccuucguguuuuuuuguuuuuuuuuuuuaguagagaugggauuucaccagguuggccaggcuggucuugaacucccaaccucaaaugaucugccugccuuggcuucccaaagugcugggauuacaggugugagucaccgugccuggccccagcuaauuuuuucuuuuucuuuuggagacagagucucgcucugccacccaggcuggagcgcaguggcgcaaucgcggcucaaugcaaccuccgccccagguucaagcgauucuccugccucagcuuccagaguagcugggauuacaggcgucuaucaccaugcccggcuaauuuuuguauuuuuaguagaggcgggguuucaccguguuggccaggcugcucucaagcuccugaccucaagugauccgcccaccucagccucccaaagugcugggauuacaggcgcucgagccaccgcgcccggcccuaauuuuuucuuuuuguagagauggggucucucucuguugccuaucucggccucccaaagugcuaggauuacaggugugagccacugcacccggcuugauaaagguauuuuuaguguggugcacaacugcuuccauaauuguagcacagauagagcugcuuauuccugcugagcuccuucuuuggcucccucccaacagucauguccccgcaugagauucuuccccucucucaaguccuggacuuacuuuccacaguuuucagaaagaugucugcuuaaggaagagguaagcugugacugaauaaaacaucaucuggacaccgggaugacacaauugacaaggagcaugaccuuugauuuuggugacauuccucauaauccacaguuugaaaauacuaucuuuaaaaacagccacuguacuagauauguaaaugcccucugauaacaccagacaccgagaaagcaccaacaacuuucaaugaagguuccuaccugucuacaagcguaaucacacuggucacacuuaaagcgcuucucauucuugugugacuucugaugcuggaugagggcauagcgcucaugaaacacagcaucacaguaacggcauuucuugccuugcucaauauaggaaugcugcuuucgcaaguggacaccugaaagcacaguaaaaagcccaggguaaugugaaaacacaaacaagcauuuuaacaaguuacuaauacauuucucgauucuuuuuuuuuuuuuuuuuuuuugagacggagucuugcucugucacccaggcuggagugcaguggcgcaaucucagcucacugcaagcuccacuucccagguucaugccauucucccgccucagccuccugaguagcugggacuacaggcgcccgccaccaugcccggcuaauuuuuuuauuuuuuauuuuuguauuuuuaguagagacaggguuucaucauguuagccaggauggucucaaucuccugaccucgugaucugcccgccucggccucccaaaaugcuggaauuauaggugugagccacugcgcccagcccauuucuccugauucuuaaguauuacucugggugcuauacagaaaaugaaugaaaaggcagaguaacaggugcagggagaacaauuaagauuguucaaacaggauaggugggagaagaugguggcugggacaagggugaugacaauggguguggauggaaggggaagaacugaugagagauggaagcaguugaaucaacaggauuuagugacuguagagagugaagaauaaaguagguaucaggccuggaaaaccagguagcuguuggggucauuuauugagacaagaauaguggaagagggcuuaagaccaaguuguauguguuauuuucagggucggggggugggggggcauaggggacagagaaguuuuagaccuucaguuuuagacaugcugaauuugaaaugccagagauauaaaagcaggggugggauggcaagggauacacaguuauauaaggcuaacucaaaagaaagaucuggaguaggaauauaaauguacaaguuguuaggauuugaaagcagcuaugcuuaucacuguaccaccaaugccacaaagaguuguuagaauuugagcccaugggagcugauaagaucaccaaggcaaaaaguagaauuaaaauaaaaagaaugggucaugcuuugagaagucuaagaguuggcaggcacaguggcucacgccuguaauccuagcacuuugggaggccauggcagguggaucaccugaggugacgaguucaagaccagccuggccaacauggcaaaacucugucucuacuaaaaaguacaaaaauuagcugggcguggugguguaugccuguaaaccuguaaucccagcuacucgggaggcugaggcaagaaaauggcuugaaccuggggggcagagguugcagugagccaagauugugcuacugcacuguacucuagccugggcgacaaagacuccaucucaaaaagaaucccagcacuuuaggaggcaaagguggguggaucaccugaggucaggaguuugagaccuggccuggccaacauauagugaaacccgucucuacugaaaaauacaaaaauuagcuaggcaugguggcguacaccuguggucccagcuacucgggaaaaugaggaaggagaaucauuuaaaccagggaaguggugguugcagugagccgagaucgcgccacucuacuccagccugggugacagagugaaacuccgucucucacacaaagcacacaagcacacauacacacaaagaagucucagaguugggccaggugugguggcucacaccuguaauccuagcauauugggaggcugagguggguggauugcuugaguccaggaguacgagaccagccugggcaacauagugaaacccugucucuaccaaaagcuaaaaaaaaaaauuagcuggucaucguggcaugugccugugguccuagcuaccagggaggcugaggugggaggauuccuugagccuggucgaugcugcagugagccaagacugagccaccgaacuccagccugggcaacagagcaagacagucuccaguaaaaaacaaaaacaaaaacaaaaaccuuggaguuaaggccagugagagaaaaaaagguuaaaauaagagaaaguuuaaagaaguaagaggaagaagaaaaccaacaggauuuagugucacagaggccaagggaagaaaguguuucaaaggaagaggguacugucaacgaugaagaacacugcuaacagaucaagucaucucuuaggaagaagaguggaaaggagucuucacuacauucagagaguggggucauucaugaccuuaagcaacagucauuauaccagagugauggggaauaagccagacaagagggaaagaugagggggagaagacugugagggauguuaacucuucauaaaggcuggcugggaaggagagaagaguuaaaccuagagggugaagacauacauauauauaaaaauacauauauauaugaauacauauauauauacacacauauauacacacacacacauauauauacacacacauacacacacacacacacacacacacacacacacacacacacacacauauauaauuuuuuuuuuuuuuuuugagacagugucucacucucuugcccaggcuggagugccguggcgcgaucuccgcucacugcaaccucccccucccggauugaagcaauucuccugccucagccucccaaguaccugggacuacaggcaugugccaccacacccggcuaauuuuuguauuuuuaguagagaugggguuucacuguguuagccaggauggucuucaucuccugaccuugugauccgcccaucucagccucccaaagugcugggauuagaggcgugagccaccgugcccggcuauauuuuuauuuauuuuaagagacggggucuugcuauaucacacagguuggucuagaacuccuggcccauccuccugaauagcugaaacuacaggugugagccacugugucuggcuaagauucuuuuuuuuuuuugagauggggucucucugucacccaagcuggagugcaguggcacgaucucggcucguugcaaccucuaccucuuaagcucaagugauccucccaccacagccuccugaguagcuggaaccaagggugcaccucaccacaaccguuuuguauuuuugguagagauggaguuuugccauguugcccaggcugcuccggaacuccuaagcucaaaugauccacccaccuuggccucccaaagugcugggauuacaggcgugagccacugcgccuggcccuuugucuuuauuuuuuaaguaggaagagaagucauuuacugagaccaagaggggagagaaaaaagaaggaaaauuagagguuauaagaaaauaggaguaggggaucugguguagcagcucucgccuguaaucccaacacuuugggaggccaaugagggcagaucacuugaggucaggaguucgagagcagccuggccaacauggugaaacccugucucuacuaaaaauacaaaaauuagccaugggcgggcaccuguagucccagccacuugggaggcugaggcaggagaagagcuugaacccaggaggcggagguugcagugaacagagaucaggccacugcacucuggccugggugacaagugcaaaacuuugucacaaaaaaaagcaagugagggcugggcgcgguggcucaugucuguaaucccagcacuuugggaggccgagguaggcagaucaccugaggucaggaguucaagaccagccuggccaacauggugaaaccccaucucuacuaaaaaauacaaaaaaaaaaaaaaaaaaaaauuuagccgggcauggugguaugcgccuauaaucucagcuacucaggaggcugaggcaggagaaucacuugaaccugggaggcacagguggcagugagcugaguucaugccaucauacuccagccugggugacgagaggaaaacuccaucucaaaaaaaaaaaaaaaaaaaguaagaguagguugcccaacucuauauaagcaccaaacacuguggaaugaauucgcucacucauaaagaacuggagcacaccugacaagaacaaacagcuggaacagcuaggagcagugagggcccagcuacauuugggaucaugaauuuauguauuuacgguacuacaaguuguaucaacugaggugauaucccacuaaacuuaaagagagcuaauuauugggaguagauaugagguaagggagaggauggcucucacuuuuuacucguuaccuuuuuuuuuuuugagacagagucgcgcucugucacccaggcuggagugcgguggcgugaucucugcucacugcaagcuccaccucccagguucacgccauucuccugccucagccucccgaguagcugggacuacaggcgcccaccaccaugcccaguuaauuuuuuguauuuuuaguagagacaggguuucaccauguuagccagaauggucucgaucgccugaccucgugauccacccgcguuggccucccaaagugcugggauuacaggugugagcugccgcgcccggccuacacuaaauauuauuaauaaacuccggcugcauguaaacucuaguuuaacuaugcacagaaauacaguuaccacuaaaccaauaaaacagucccauuaccuagagaaaguacagacguucucaaaaaaauacaauagaaugaccugaguuugaaucacacuauguuacuuuccuauuuggggaaggaaggcuacuaauuaaagguguacucugucuccucccaucacagcucccauuaauuuauagaugaguuuuacucaggacagaaucuuguggccugacuacaguaagaaaaggaagaaauagaaaaaaaaaaaaaaaaaaagcagcuaagcaauggcuuuuacuaaacuaagugacaggccauuccuauacauaaaauguuaugagagucagaaggugaaguuauuuuugauccccauauuucgaaauauaaauccuucaaaauauuuuuuucacuucucacuaguuaaucuacuuacccaaaucacuuuuucgggcuaugacugugucacaguggggacagugaaauuuggccacauuuucugugugcuucuguaaaaugugcaucuucaugguaccacuuuggguaaaccgagcaugacaaauauaacauucauaaggcuuuuccccuuuaaagaaaauacagaaugaacacauaaaugaaaugaauaaauacuguaauuuaacuggaggguaacucagguggcagauaugcuacaccacagagaaucuacaggucuuaggaaggcugaggcucagucccaguucccggaucuugucuaucuucagauauggccaaguccuaaacugcugcuggccaccucugcucugcccagcucuacucuggaauccuccacauuacagcaaugcuuaccuuugggggagacugaauggagaacccacaaguuuuucuuuuuaggaaaagacaauauccaggaaaacugaauaagguagguuaggaaaucuacccagacuuuuaaaauuaaaaucuguccauuuuaacuuaauuucucccuuaaaauuuuucuuguuguaggcagauucaaguugaacaaaacaaaagguacuauuuucuaauguguuuucugaacaacgaauucagaggauaugccggagaagcauuaucaauuccauacuauuuucaugccagucuucauucauauaaacaauggggacacacagugguccacagggucccaugggauucacugaaaagaagcucauuaauacaguaaggaguggagaaguccuaccugaauggguucucaugugccuuuucagcuuguaugugucccugcuggcauaacugcacaaacugcacugaaacggacgcucuccaguaugagagcgaaugugacguuuuaauuugcugaccugaaauacgaaaacaaccgaacuuuaacuucuguuaacacagacuguaacaagagcacaguagguuaggcacaaaagcuuagcuuuggggcacugaaguucagaauacagaagucuaaaagauaaccuucuucccucuucauuauuuguaaacuuugcuucucgaauccauaucauuaucuaagagaaguggguaaaugaauacggguauagauaagccaagauuggucauuacuugggaggcugaggugggcagaucaucugaggucaggaguucaagaccagccuggccaaauggugagaccccguaucuacuaacaauacaaaaauuagccaagcaugguggcacacgccuguaaucccagcuacucggaaggcugaggcuggagaaucucuugaacccaggagguggaggcugcagugacccgagaucgugccacugcacuccaaccuggacaagggcgaaacucugucucaaaaaaaaagacugcgcauuacuaguaacuguuuaagcugggugguaggcacaugaggauguauuacaaucuuuacuucuacauguuugaaauuuuccauaauaguuuaaaaauaauccaugccuauuuacagaucaauuuguuccaaauccuguguuacugaguacauauuuuaauuccacucauccucuuuuccuaucauuagcguuuccuagacaggccaggcucgaagggccucucuucuaucauccucaccauuauccauccuuuaguccccugcaggauaccuuauacuaaaacagugacuuucaaacuugauucuaugaagugcuuugagggcaggucacgguggcucacaccuguagucccagcacuuuggcaggcccaaggcgugcgauugcuugaggucaggaguucgagaccagccugggcaacauggcaaaacccugucucuacaaaaaauacaaaaauuaguugggugugauggcacaugccuguagucucagcuacgugaggagcagcugaagugggaggaucaccugagcucaggaguuuaaggcuacagugagccaugaucacgccacugcaguccagccugggcgacagagugagagacccugucugccacgcacccccugcuccaaaaagcguuuugaacauucacuaauguuucaauguuuguuuugaaaaauuuaaaaaguaucccaauuuuaaggaaacaaacaaacaaaaaacaaaaaaacacuguacucauaaaugucucugaguuuuuuuugguuuuuuuugagaugaaaucucgcuccguugcccaggcuggaguacacugucacgauugugggucacugcaaccuccgccucccagggucaagcaauucuccugccucagccucccgaguagcugagacuacaggcgcacgccaccaggccuggcuaacuucuguauuuuuaguagagacgggguuucaccacguuggcccggcuggucucaaacucuugaucucaggugaccaacccgccucagcuucccaaagugcugggauuacaggcgugagcuaccgcgccuggccccacucauaaguguuacacaccaaguuuucacacacauaagucgauaacuauccuaacagcguuacuaauucuuuuccuucaagauuucccuauuuaaccuguuaauuucaauauguaccagaaccuacucuguuccaaugagcuaucuauuccuacugcaauaucacacuggcuucauuuacuauaguuuuacaaaauccaauggcacaagccccucauucuauuuucaaauuuuucuuagccauucauauuuauucuuccaguugaaaguuagaaucaacuuguaauguuucuucauuuauucagguccucuggaaaaguuacugagguuuucuucauguacauuucauagauauuuuuuguuguucaguuuaucccucaguuauuuuauugcuauuagaauccauuucauaccuuccuaucacuauugacguuacugauuucuguaugcuuaucuuauauccggccagugaacugaacucuuauugcucuaaguuuuuguucugauacucuuagauuuucucuguaagcaaaucucucugcaagaaauaacaguuuuaucuuuccauuaauaauucauuucuugcuuuauucgauuagcuaggauuuccaguacaaagcugaaacaguaacauuaagaaugaauaucuugucauauuccagauuuuaauggaaauacuuucaauguuucagaauuaauuaggaugaguuuauuauacauuucugguauauaugcuguuuaaaauuuuuuugagggggagucucacucaucacccaggcuggagugcaguggugcgaucuugccucaaugcaaccuucaccucccagguucaagugauucuccugccucaggcucccgagucgcugagacuacaggcgcaugcugccaugcccagcuaauuuuuguauuuuuaguacagaugguguuucaccauguuggccacacuggucaacuccugaccucaggugaucugcccaccucaaccucccaaaguacugggauuacaggcgugagccaccaugcccagccuaaacacauuauauuaaagaaguuuucuccuauacguaacuugcuaggacauuaaacaguaauuaaugauuacugaauuuuagcucccaucccaucuacagaaauaauaugguuuuucuucaauccuucaauguaauauacaucagcaauuucccaaugauaaacaaucuuuguguuucagauauauucaguaucacuuauuuuuagaacguauuacuaaauuagguuggcucauuggcuaauaauuucauuuagaauuuuugcuucucucugaggguaaguuuucuuuuugguaguuuucugacccaguuuugguaacaguguagcuucaaauaauaaaauugauaaaccuaccauuuuaaaaugcucuggguacaguuuuuucuucaaaguuugacagaauuugccuguauuaacaugugaaacugguacucuuuuuuaagacggaguuucacucuuguugcccaggcuggacugcaauggcacgaucucggcucacugcaaccuccaccucccggguucaagugauucuccugccucagccucccaaguagcugggauuacaggcaugcaccaccacgcccagcuaauauuuauuuauuuauuuauuauuauuuuuugagauggagggagucucgcucugucgcccaggcuggagugcaguggcgugauuucagcucacugcaagcucugccucugggguucacgccauucuccugccucagccucccgaguagcugggacuauaggugccugccaccacacccagcuaauuuuuuguauuuuuaguagagacaggguuucaccguuuuagccaggauggucucaaucuccugaccuugugauccacccaccucagccucccaaacugcugggauuauaggcugugagccaccaggcccagccuaaauuuuuuauuuuuuaguacagaucggguuucuccauguuggucaagcuggucuccaacucccgaccucaggugauccgcccaccucagccucccaaagugcugggauuauaggcgugagccaccgcacccagccagaaacuugacucuuuuuaacaaguaaaucuuucacaaucaucauaaguuuuuugggggagcgguguugugugggaguguuaauaauuuacuaacauuuuucuaccucaucuuaaguccguuuggguaguaguuauagcuuuguauugaaauaaaucauggucugccuaagagagauaccaacaaaaagcugaacacucacuucuacacuggcguaaucgcacauggaacacuugaauggcuucucguggguguguuuguaacgacgaugccgaaccaauucuccacuggucacaaaggccaugucgcagucugggcacuugugaggacgaguaccuagagaaaggauggaguaacaggaagagcaagaucaagggcacaguuaaugacagaguucaauguguggcacagaacugcuaugagacuggaacccuauucaucccaucaacugcaguagcuugaaagcagauacaaaagucagcuccgaaaacuaugggagggccuggaugaauuuauacuaacaccaggauauuauaacacauaccaaauuaguuucucuuaauuacccaucugaauccgcugccuuugaauacaauaaaaaccuucuuauuccuauuuugugaauauccuggucauuauggauuaaaaguuaauagagaccgggcuugguggcucaugccucuaaucccagaacucugggaggcuaagaguuugagaccagccugggcaacauagcaagauccugucucucaaaucucguuguauuaugacuauaaauauagggccauugggcuguccauauucugcaacuuucuuuuaaaaacacaaacauauaacuuguuuuccacauguaucugucuugauaaggaauuucagaggcuuaucacaggcuuuacauaguauuuccuuuuaugugauuuaaacaaaugauuuucaaacauccaugucuaauaugcugugaucauucugaaugucaauucauccaauauaaaacaugaauaauauacucucuacauuucuugucuuucacugaaggaaucuuagagacaaaacugagagcacaaugcagugcuaguuucacagacuagugaccaucuguaauugugggcagcagguaaggggugacagcaagguaguaucaaacacuaaaaccaaaggaaggcugccuuugaggauacaauuaggaagagccacaauguaaugaauagaaccagccaucugcagaaaugauucucuuugagaaugaagagaaugcuggagaggaagagugacuggaguauaauaaaaacuaagcaauuccaaggaauguucauuuguucauucgauucuuuagaaccacuauggaucuaacgguaaagcacagaguucuuccugugaaaguguauagucuggugguauggauaagaaguaaaacaauuaacaagagaagaaaaguggcauccaauuuucuuuucguuuuuuguuuuugagccagggucuuccucuguuacccagugggagugcagugauaggaucaaggcucacugcagccuugacuucccaggcucaagugauccuccuacuucagccucuccaguagcugagacuacaggcuugcaccaccaugccuggcuaauuuuuucuauuuuguagagauggagucuugccacguugcccaggcuugucucaaacuccugggcucaagcaauccuccggccucggccucacaaaguccugagauuacagguugugagccaccaugcuuggucuucuuuuagaacaaaguaagcuaaaaaauaaaugcucguguuuaccuaguacuauccagggcagagaaaggccugcauaagcguggcaauuagcaaagaaguggacacugcuguggggcagggaguuccauuaggcugugccacaugaccaccuacaucccuucacucaaggcccauccucuuuuuuuugagacggagucucuugcucugucgcccagguuguagugcaguagcaugauuuuggcucacugcaaccucuaccuuccagguugaaguaauucucuugccucagccuccugaguagcugggacuacagguacaugccaccacaccuggcuaacauuuuuuuuuucuauuuucaguagagacgggguuucaccauguuggccaggauggucucgaucuccugcccuugugauccgccugcuucagccucccgaagugcugggauuacaggcaugggccaccaugccuggcuuuuucuugagaccgaguuuugcucuuguugcccaggcuggagugcaauggcacgaucucagcucaccgcaaccuccgccuccuggguuuaagugauucuccugccucagccucccgaguaguugggauuacaggcaugugccaccacacccggcuaauuuuguauuuuuaauagagacaggauuuccccauguuggucaggcuagucuugaacuccugaccucaggugaucugcccgcgucagccucccaaagugccaaagugcugggauuacaggcguaagccaccacacccggccaccuggcuaauuuuuguauuuuuaguggagaugagguuucaucauguuggccagacuggucucaaaccccugaccucaagugauccacccgccucagccucccuaggugcagggauuacaggugugagccaccaugcccagccaucaaggcucauccucaccaaguuagcuuucaauugcuacaacaucuuuuuuuuuuuuuuuuuuuuuugagauggagucucacucugucgcccaggcuggagugcaauggugcgaucuccacucacugcaauuucugcuuccuggauuuaagcaauucuccugccucagccuuccgaguagcugggacuacaggcaugcgucaccacgcccggcuaauuuuuauauuuuuaguagagacgagguuucgucauguuagccaggcuggucuugaacuccugaccucaggugauccacccaccucggccucccaaagugaugggauuacaggcgagagcuacggcgcccggcugcuacagcaucguaacagaggcaaaggcgcccccuagaaugcaaugcaacugcaucuggaacaugaaaagguauacuccucaccauaaacugauacucuugguguaugcaucugcucuuauggguuuuguugguaugaaucagucuugccaaaucugcugaguaaccagauagacuguaccucuuacuuucaaagcugaagaccagauagagaaugcccacaccaaggcacacccaucuugggaaguccuguuauggggccauuuauuuauuuauuuauuuauuuuggugaggcagagucuugcucugucacuuagguuggaguacgguggcacaaucuuggcuuacugcaaccucugucucccgcauucaagugauucuccugccucagccacccaaguagcuggguuuacaggcgugugccacuacacccagcugauuuuuuguauuuucaguacagaggcgguuuugccauguuggccgggcuggucuagaacuccuggccucaggucaucuaccccccauuggauuuccaaagugcugggauuacccaguuacuuuuauuuagucauaugccccauccuagugucuucaaaguaucaaauaaaacauauuaucaagugucugaguagaaauuagggagauguuuaaaaguaagucacauuagugaagaaugugcccaugugcagcauacuguuuaugauuaacacccacuugaucauggucaucugacaaccagcacaacaaaucuaaaacaaggguugucauuagaaauuuuuaaaaaccuaaaaaucaaaaacaagaguugucauaugaaaugaaguuauucugcaugaaaaaccaugugagaagacuugcaaccaacuuccuacacugggauaacaaauagcucaggaaagcuuaaagagagguuuagugcacagagucccucuacuuuagagaccucagggaaccuggccacagccaacaugaagcuaauaucagaauaucugaacacuaaaguaaguaggaugcucaaauaaauguuugaauuaucagaauggugccuuagcuuuuccauucugaaauuaugaauuaucuuccuugacgugaaacaaccagaaacaaaaaauguuaagguuuguuuuugagauggagucucacucugucgcccaggcuggagugcaguagcacuaucucagcucauugcagugucugccucccagguuucaagcgauucuccugccugagccuccugaguagcugggauuacaggcacccgccaccacaccuggcuaauuuauguauuucuaguacagauggaugugauuuugucacguuggccaggcuggucuccaacuucuaaucucaagugaucugcccaccucagccucccagaguguuaggauuacaggcgugagccacuguacccggccacuuuuuuuuuuuuaaauaaagguaggauuucacuucuauuucuuuucuuuucuuuuuuuuuagacggagacucgcacugucgcccaggcuggagugcaguggugggaucucggcuaacugcaagcuccaccucccggguucacgccauucuccugccucagccucccgaguagcugggacuacaggcgcccaccaccacacccagcuaauuuuuuguauuuuuaguagagacaggguuucacugggauuucacuucuauuucuaacauucuuccucauaguaccaggcaucuauugccugagacuucuuuuuuuuaagagagaggguguuauuuuucauuaaauuuucuuuacauuugucuauaauaacuaaguccaagugcuuacaauaaaaucaugauuacaaaaagggcaucauaagaaauaauaaaaacuuccuuuaaauucccgcuggagucagcuugaaugaauacuaaaaagcgaagucugagcauuugcuguuguagcccccaacauucuuauccagcaccuguguguguguuaaggugauuccucaggagggugacuguucugaaugcccugccacagagauggcacuuguguggucucucaucaguguggcuuuucaugugacgauccaaauuugaacgccguggacacguguaacugcaaagcucacacuggaaugucuucuuuacaccuaugugcaaaauaaaacacuuacuugcugcagaguuucaaaguguuaagauuaauccuaaucuuaaauuucuacaaauauauuugauuagcuuuuaauaacaaaacccaauauaagucauaauuaucucaugucacuaauacauuuccuucuucuuugggauuaaaaaaagagcauucaaucuggaaaaaacuuauuuuagacugguuuuaaagaacgguacccacauaacgaccuuuuacaaauacgguuaauauaaaacaacuugcauaugcacuguguuguaugcuuaucccaaaaugguuuuaugaaaccacuauggauaaacucguuuuaccuuucuuuuuaauuuuuguuggcuuuggaggcuucauauuaccaaccacuuucucugcauuaaccucugauagcagacccuccugcuguucuuccucaaaaucguagacagacacaucuacaucuuugcccuccucuguauaacgcaguuugcucuuuuugguuuucuuuguuuuuuuggcugguggcugauagucugggucuuuuugccaacuaggaucuuccugggguggaaguuccccuuguucuagugucuccaccucuccauuggcccccacuuuaaccaccugaaacccuucaggcaaagguaggguguggcauaucauggguucacuuuccgcaaggcccucuuuagacacuucauuuucauaagcccccugaaguucuucuacugaagugguagcaacagguacagucacaggaacagguacuugaacaagcugaaguucuccuauguuuaugggcuguuccuccauauuuacaaccuguaaaguuauaaucuggguaucguccacagcagccucugcuucuggagccacugugcccuccauuacuucagucuucaucugaagaagggugggguccagcuguuccaucaucaccaucuguacacugcuguugacauccuggaccaccucacccccauccgucugguucugggguaaguggcaggcaucuucuuccuggcccccuucccggcgucucugguaagucuuucucuccuuuccuuuaauaaaaguuucggacuccuccacaauggcuucgacugcaucaccuuccauuuccccugccuuuauuaagggagaacacagauuguuauuuaaagcaaagcaugucuaaauaaaaauauacauuuuaaaacaaaaagacccuuuggugaaugaauuaggcaucaaugguuguuaauauuaaaaaagacacaacagacaugugccucuugaugaaagaaacaaccacuacuggccaggugcaguggcucacgccuguaaucccagcacuuugggaggcugaggcgggcggaucacgaggucaggagaucgagaacauccuggcuaacacggugaaaccccgucucuacuaaaaauacaaaaaaaauuagccaggcaugguggcgggcgccuguagucccagcuacucgggaggcugaggcagaagaauagcuugaauccaggaggcggagcuugcagugagccgagauugcaccacugcgcuccagcgugggggacagagcaagacuccaucucaaaaaaaaaaaaaaaaaaaagaaaaagaaaaaaccacuaccuauaaugcaauuuugucaaacaaacuccaaaacucugaaaccaaucaagucucuagauccaacccaauuaacaggaaauuggugacucaggauguuaaauuauacuacagggauuaaaucagugaaauccauaccgagggaaacacugcaagauuauacucagguucuucugcaaauagauaacaagaagaauacaagggaagacugauuggagggagaaccaguagaucaguaguucucagccuggggugacuuugccucuaggaacauuuggcuaacacauuuuugguugucacuacugggcugggaugugcuacuguuaucucgugggugaaagcuagagaugcuauuaaacauccuccaagacacaggucaguccuccaccacaaagaauuaucaggccaggccgggcacgguggcucacgccuguaaucccagcacuuugggaggcugaggcgggcagauuaccggaggucaggagaucgagaccauccuggcuaacacggugaaaccccgucucuacuaaaaaauacaaaaaaauuagccgggcgugguggugggcgccuguagucccagcucuugggaggcugaggcaggagaauggcgugaaccugggaggcggagcuugcagugagccaagaucgcgccacugcacuccagccugggcgacagagcgagauuccaucucaaaaaaaaaaaaaaaaagaauuaucaggcccaagaugucaagagcacugaggcugagaaacucugauacagauaaaagagucuuaaagagacaguaaucaaucacaaugcaugaaucuucuuuggauccugauucaaaccaauaaauggugaaaaagaugugacacaagacaauuagaaauuucaacucuggauaucugaugauauuaaagaauuacuaacaaaacuaauuuaaaucuuacacauguaguggggaagacacugguaaaggacauauaauuucagugggaauaaguucaagagaucuauuauacaacaugaauauuacaguuaauaauaacguauaccugaaaauaacugagagcagauuuuuaaguguucucaucacaaaaaaugacaaggaugugagaugaugcauauaugaauuagcuuaauuuucugcaauuauggggucuugccacauuuccagacuggccuugaacuccugggcugaagcaauccucccaccuaagccucccaaagugcugggauuauacaugugacugagccacugugcccgggucugccaauguuuuguaaaaagcuuuauuaagguagcuuuauuaagcacgugguggcucacgccuauaaucccagcacuuugggaggcugagguguguggaucaccugaggucgggaguacgagaccacccugaacaacauggagaaaccccguccuaaguaaaaauacaaaauuagccaggugugauggugcaugccuguauguaauccuggcuacuugggaggcugaggcaggagaaucguuugacccgggagguggagguugcggugagccaagauugcgccauuguacugugcagccugggcaacaagaacgaaacuccgucucaaaaaagaaaaaaaaaaacacuaaauacaccuccaaaauuuccuuguauuuuguuuuuggugauaauauuuaucaugagauccauccucaacauaauucaaagugcauaaugcuauacgauuaauacaggaacuauguuguguagcagaucucuagaacuuacucaucuugcauaacugaaacuuuauacccacucaacagcaauuccccauuuuccccacccugucaaggguuuuugaccuuguuuuuugaagccaaacucagaacuuagauccagacugcaauggccguguuuguagacacugcacaaaacugcccaugucauaccaucaacuugacauucaccucucuccugacaaugagaucaggaauucccugagaauaagaaccacaucuaacaagucguuuuuuuuuuuuuaauuuuuuuuuugagacggagucucgcucuguugcccaggcuagggugcaguggcacgaucuccgcucacugcaagcuccgccucccagguucacgccauucuccugccucagccucccgaguagcugggacuacaggcgcccaccaccaugcccggcuaauuuuuuguauuuuuaguagagacgggguuucaccauguuagccaggauggucucgauuuccugaccucgugauccgccugccucggccucccaaagugcugggauuacaggugugagccacugcgcccaaccgguuuuuacuuuuuuuuuuuuuuugagucggagucucgcacugucgcccaggcuggagugcaauggcgugaucuuggcucacugcaaccucugccucccagguuuaagugauucuccugcuucagccuccggaguaguugggauuacaggugcccaccaccacaccuggcuaauuuucuguauuuuuagcagauacgggguuucacuauguuggccaggcuggucuugaacuucugaccucgugaucuguccgccucggccucccaaagugcugggacuacaggcgugagccaccacgcccagccacgguuuuuacucuuuagcacugugcccaggaugguaaguacucaauaaaugccaaccaaauugaauauauaauagaaagcagaaaacaaaucagccaauucauaguuuuuggcucuuauaucuugugaaugggccgggcacgguagcucacgccuguaaucccagcacuuugggaggccaaggcugguggaucaguugaggccaggaguucaagaccagccuggcuaacauggcaaaaccccaucucuacuaaaaauacaaaaauuagccaggcguaguggugugcaccuguaaucccagcuacuugggaggcugaggcacgaaaagaacuugaacccuggagguggagguugcagcgagcugagaaagugccccugcauuccagccugggcgacagagugagacucggucucaaaaacaaaaaauaaaaaacaaacaaaaaucuugugaaugacauuaccuaaacaagaguaaaauaggggccaggcgugguggcucaggccuguaaucccagcauuuugggaggccgaggcgggcagaucacuugaagucaggagauggagacaagccuggccaacacggcaaaaccccguuucuauuaaaaauacaaaaauuagccaggugugguggcacaugccuguaaucccagcuacucaggaggccgaggcagaagaauugcuugaaccugggagguggagguugcagugagcugagauugggccacuguacucccuccagccagggcaacagagcgagccucugucucaaaaaaauaauaauaauuaaaauaaaauaaaacauauauagcugagugugguggggugugccucuaaucccagcuacuuggaaggcugagugaggcucgagaauugcuugaagccuggaggcggagauugcagugagccgagugccacugcacuccagccuggagccugggcgauaagagugaaacuaugucucaaaaaaaaaaaaaaaaaaaacccaaaacaaaacauugaaguguuuuguauuuuuggccaagaauacagcucaaacgaagcuuuuguuaguucuauuagacacacuuuucuccaauucucugucuaggcaccuuaacauuguauuauauccaugauagcagucagagaagacuccuuaagccaggaccaccugagaggcagcacaagaacuacuacagagagaaugacauuaccuaaacaagagcaaaauaggggccgggcgugguggcucacgccuguaaucccagcauuuugggaggccugguccuacauucuaggaguuacugucuaacauaaaggacaaaauagguagcacaaugguucaaggugaaauuacauagguuuggagaaagauaacauaaccaggugugauagaaaaaugcuucauaaauguggaauuugaacggaacccugaaacgugagcaggacauuuaaaggcagaguuugacaguggagggcagaggauguauucuguaggggaaagguuuggauuucuggguacaauaaauacaugugggaauuaguuaugaguaagaaaaagaacuggcuuaaagcacaggacagaggagaggguaguaagacaggugaaagaugugcugguugccccccauaguuuggauggucuugaauaacaaaauaccucagaugacuggcaauggaaaaccacuuaugcuuucugggcagagaaguaaagauucacucauuucacaaagaagaagacuuaauuuccucaaaaagugugucucuacuuuugcaaaaacuacaugaugcacuuaccacccuucuggcucacaaagccccuucguaccugaccccaugauaaccuauucagauuuaugucuugcccucuagcacucuccccuucagucaagcugucuuuucauccagacacaguuccuacugucaucucccugucuucacucuguacuuuacgucugauccacuccucucaacaccagcucaucccuggcacaacaaagcuuucugagguucuuguggccacuacuuugcuccaaauguguuucugauaaaauaaggacacaguuuagcacuuaaaauuuucucaaaacgaucuauuuucccaguugggugugaaagcucuuuaagggcaaaagccgggcuugaagcaacauauacuuuuggacagauucagcaaaccccaccaucugccuggaaaaaaacaaggcucaagguaaacucccgagguuguuggauugccaguuugguuuauucuuccauuaccuucuuucuuucauuagucccuuguucucaacaaccaagagaaaaauacaacaacauccaaugcaaaggcuucuuacuaugcuguuccaugacaguggggacaaauauaaaaaaauguuaccgcagaagguggggaucaaagaacauuuguagaaugcuuuauaauucaccuauaaauuaaaaaugagcaaagugcuaguauuuuuauuauaagaugucauuuaggccaagcgugguggcucacgccuguaaucccagcacuuugggaggcgaaggcggguggaucaugaggucaggagaccgagaccauccuggcuaacacggugaaacaccaucucuacuaaaaaauacaaaaaauuagccaggagugguggcgggugccuguagucccagcuacucgggaggcugaggcaggagaauggcgugaacccggaaggcgaagcuugccaugagccgagauugcgccacugcacuccagccugggagacagagcgagacugucucaaaaaaaaaaaaaaaaaaaaaaaaaaaaucccauuuauaccucugauuguaaaagacuaagcauaauccuaacuauaauuaauuuuauauacucaguacuguucagacagauuaucuuuagaauauaaauucucuaggcuggcacuguucaauagaaauauaaugcaagccacaaacauaagccacauuauauguaauuuuaaguaaaaaaaauucauauuaaaaaguaaaaaaaaaaaacaaaaaacaaaaaaaaaaaaaacccuggugaaauuaauuuuaguaaucuauuuuacuuaaccugguauguccaaaauaucauuucaagguuucaucaauuuaaaaaauuguuggccggguaugguggcucaugucuguaaucccaacacuuugggaggccaaggcagguggaucaugaggucaggagauacagaccauccuggcuaacauggcgaaauccugucucuacuaaaaauacaaaaauuagccgggcgugguggcggaugccuauagucccagcuacuugggaggcugaggcaggagaauggugugaaccugggagguggagcuugcaaugagccaagaucgcgccacugcacuccagccuggcaacagagcgagacucugucucaaaaacaaacaaacaaaacaaaaacaaaacuaacaaaaaaaauuguuaugcuugagacacagacuugcucuguugcccagacuggagugcagugguaggaucacagcucacuguaaccuccaacuccugggcuccagugauccuccugccucagucugccaaguagcuaggacuacaguuuaugccaccaugcucaauuaauuuucuuuucuuuucuuuuuuuuuuuuuuuuugagacgggguuuccucuguugcccaggcuggagugcagcagaauggucauggcucauugcagccuugacuuccugggcucaggugauucucccaccucagccucccgaguagcugggacuacagguucauaccaggcaccaggcuaauuuuuuuguauuuuuaguaaaagugggguuucaccauguugcacagacuggucucgaacuccugggcucaagucaucugcccgccucagccucccaaauugcuaggauuacaggcauaaaccaccgugccuggccucuaauuuuuuuuuuuuuuuuugagacagagucuugcacuguugcccaggcugaagugcaguggcgcgaucucagcucacugcaagcuccaccuacuggguuaacgccauucuccugccucagccucccaaguagcugggacuacaggcuccugucaccacgcccggcuaauuuuuuguacuuuuaguagagacgggguuucaccguguuagccaggauggucucuuaucuccugaccuccugauccgcccgccuuggccucccaaaguaccaggauuacaggugugagccaccacacccagccuuuuuuuuuugagagggagucucccucugucgcccaggcuggagugcagggacuugaucucggcucacugcaagcuccgccucccggguucaugccauucucccaccucagccuccugaguagcugggacuacaggcacccaccagcacucccagcuaauuuuguuuuuguauuuuuaguagggacgggguuucaccauguuaggcaggauggucucgaucuccugaccucgugaucccccaccucagccucccaaagugcugggauuacaggugugagccacugcgcccggccuaauguuuucuuuuuuuguaauuuuuuuuuuguagagguguguugcccaggcuggucuugaacucccagccucaaguuauugucccaucuuagacuaccaaagugcugugauuacagguaugugccgucgugcccagcuauaucuuacauuuacagcauaccuuaauuugaaccagugaaacucuaaauucucaacagcaacaugaggcuaggggcuuccguaccggacagcacaacuuuguacuuguuauucaaaguauggucugaggaccagcagcacuggcuucuuaaaaacacagaacuucaggucccacccuugacccacagaauuagauuuugcaauuuaacuuuauacuauuacuguuuccccauuaagauuuucuucucuuuuuuuuuuuuuuuuuuuggagauggaguuucacucuuguugccuaggcuggagugcaauggcgcaaucucggcugaacacaaccuccgacuccuggguucaagcgauucuccugccucagccucccgaguagcugggauuacaggcaugcgccaccacaccuggcuaauuuuauauuuuuaggagagacaggguuucuccauguuggucaggcuggucuugaacuccugaccucagguaaucugccggccucggccucccaaagugcugggauuaaagacaugaaccaccgugcccagcccccagaaaaaaacuuuuuaagagaaguuuuucagucccugaaaagccccaaaaguuaguaucccugcaaagggaaugauaauccagaugucuggagcuagggaacauacaaaaagcccaauuuacuucagagugacauucucagaaaagguaucaaagaacaaaaaauugagaugcugugaauguaaauguggugacccugccagagucacuacauaaucccagacuauuuaaauauccucaauaauaaaauugguagaggaaaaacaaucuuuggggucuccaggauuuuguagcauauaauuugaugcuacaacuugaagacaacggaaaaaaauucuaucuggucucuggugugaauuugaaaacuuaaaauguuaaaaauugcuuguaaacaggcugggcugaguggcucacgccuguaaucccagcacuuugggaggccgaggcaggcggaucaccugaggucaggaguucacgaccagccugaccuacauggugaaaccccaucucuacuaaaaauacgaaaauuagccaguugugguggcaggugccuauagucccagcuauuugggaggcugaggcaggagaaucgcgugaacccuggaggcggaggcugcagugagccaagauugggccacugcacuccagccugggugacagagggagacuccaucucaaaaaaaaaaaaaaaaauugcuuguaaacaaccgaguccaaccuaaaagaggucacagaauuauaaaccagguagaaaaagaagugguacaaaagaguacaaauagaaaccaacugugcuuccaagaaguugagcugacagaguacugucucacugaaaaaaaacacauggcauaaaguccacaaaacaacagcaucuacucggucuuaaagcaauagcuucuauuuuuaauagagaaaaaucagacacaaaguagcaagccaucagccucucaauacacugcucagaaucucagagcauccccgaggucaggagaucgagaccauccuggcuaacauggugaaaccccaucucgacuagaaauacaaaaacaaaauuagcugggcgugguggcaggcgccuguagucccagcuacugggaaggcugaggugggagaauggcaugaacccgagagguggagcuugcagugagccgagaucacgccacugcacuccaggcugggugacagagugagacuccgucuuaaaaaaaaacaaaacaaaacacacacacacacacacacacacacacacacacacacacacacggugacagagugagacucugucuuaaaaaacaaaacaaaacacacacacacacacacacacacacacacacacacaccccuuagugcauuccaucaagcaguggaucucuccuuuuacuuucuuuccagacgaugggagucucuccucugaaucaauaaguaaccaauaggcuggaccaggucauucuccccacucccuggggacugcgcuucuagcugccucucccgacacuagcagcuccaauccaucuccuuucuuuacugcuuucaaauacucaguuccucuuaguacaaaacauacccacucacucuaauuccuacauauuuuuuggcucuaugcuugcuugagucgcccaugccuucuagguuucaucaaauauuuuuuguggaccaauaucgccaccaaaaugaaguuuauaucacucaaagcgguuuuaauuuacuuacaggacacauuuuuuuuccuccagauuacgaaaaucaccuaauauucugaugcuguuuucucagcuauucaguuaaagguauauauuuuguauauauaugaaaucauacuauauauggaauuuauauacacuucuauauauggcuuugcucuaucucaaaaaaucuguccuuaugacuaggugugauggcucaagccuguaaucccagcacuuugggaggcugaaguagaucacuugagcccaagaguucaagcccagcacaggcaacauggggagaccccaucucuaaaaacaaauuuuaaaaaacacacauuagccaggcuaggcaugguggcucacaccuguaaucccaggacuuugggaggcugaggugggcagaucccuugaguccaggaguucgagaccagcuugggcaacauggugaaacaccaucucuacaaaauauagccaggcaugguggugcaugccuguaaccccagcuacuugggaggcugaggcaggaggaucauuugagccuaggacacagagguuacagugagcugagauuacaccauugaacuccaaccugggcaacagagugagacucuguuccucaaaaauaaaaaaaauaaaaaaaauaauaaauuuaaauaucuguccuuacuaaaaaggacucaacucccuccuuagcccucugcggccccuuuguuuggcccacagguaccauccaucaagaaccaccagagucaacccaagggccuuucccucuuucuaaaucucaguuucucuggcaucugacaagaugaaacucauccuauuccuucauaagccucuuuccucccuuagcucccuucgucucugaguacucuuucaccagccccccugagcacaccaaggcuccguagccgcccauuacacuagccuuuuaacuuccacuguuucuacacagaggucuuuccaauccauaucugcaaucccaguuucacugccuaaaggaucuacuaauguuuggcugucaccuucaacucaaugacacuggacagggaauaaacagaaacuccaguauacccaauccaucacuaaccaacuaaaugagcuuggcaaagugggugguuuagucguccggacugugguaucaccauaaaauggagcuccuaagaccagauccuuauuguguuucucuaucaucuaggugaaaaagugaagcuuagauaaaaaaauuuuauuauucagucaacuucuguguagaugaugaacaggagguuccuccagacugaggaagaacaauccaggcaaucggggaugaggggcuaaaaggaaggaaaacuggcaucuuaaugcuucucugccccugcugaauggugagugugaggaugcaagggccuaggcuccaacacagagaccccagaggccuguauccuuagggggcauggaucaguucuuccuccucuugcuucagccacuuauuuuucuuugagacagauucucguucuguugcccaggcuggagcgcaguggcacgaccucggcucacugcaaccucugccucccagguucaagugauucucuugccucagccuccugagcagcugggacuaccagcgcgugccaccaggcccaacuaguuuuuguauuuuuacuagagacgagguuucaccacguuggccaggauggucucgaucuccugaccucgugauccaccagccucggccucccaaagugcugggauuacaggcgugagccaccacauucggccgcuucagccaccgcacccggccacuucagccacuucuuagcuagcucuauguugcuuaaaucuugcccauuuauaacuccccucaaccccaaugcacgauuuaguaucugucaucucuuuuuuccuaccacgcucaacuuaacacuugcugucucuaauucuuuccuuacuuuccacucaccaguuugguuucugauccccaauacuuuacggagcugcucugaggccagcaauggccuuuaauugguaaauccaccgaggcuuuucuguccucaucugacuugaccucucuguggaauucagcauucuagucuaggcuuuaucccagaauuaugccagaccaucagaaagcuggguauacuugggccacacggccuuauccccuacagaauugcuuuuaucgaguuucacuuuggcaucaugccuuagcuuacacuaaaagauaugugggagaaauugcacugggaguuaaauacuuggaaaagcuuuucuucaaggaaauuuuuuucuuucauugugaaaccuauguaacaggaucauguugccauuuuuuuagcuggcuacagcuugauuaauuuguugccucucaaaccauguaauaauaacuuucuauuauaauuuguauuuucugguuuauuuauaucacuuauuaucugucuuuccuaaauauuucuucaaguucuuucuggaacaagaugggcuauaaacuugaaaguguauauacaaucuauuaaauaaauauaggaaaauauacauaaacauaaaaagauacaagaaaaagaauaacgugaacugaaaaugugcagggucuauuugaagauuauaaaacucuuccacuggccaggugcagugacucacaccugacugcuaggacuuugggaggcugaggagaguggauugcuugagcacaggagucugagaccaggccugggcaacacaguaggacaccaucucuacaaaaacuuuaaaaaauuagucaggugugaugguguaugccuguagucccagcuaccuggaggcuaagcugggaggaucgccugagcccaggagguuaaggcuauagugaguagugaucaugccucugcacucuggccugggcaauaaagugagacauggucuaaaaaaaaacuaagaaaaacaaaaccaaaaagaaaacaacccuuccccuccagccccaaacuccuccaggaggcauuuaaaaaaccucacuaaguagcgacacuauuaucuauauccauaaagcuacauaauucauauaaugugguacuguuacuacuauaggcagacaauuuaaacagaagagagaauccagaaacaaagccuagcaaauaaaaagcugucauuuuaaaucaguagggaaaagagaauuacugcauaaaagguaccagaaaaacaguuaacuauguaggaaaaaaacagaaguuaucuuuaauccauuuggaauguaucuguuguaugaaacaaagaagcauuggcagggccaagugugguggcucacgccuguaaucucagcacuucgggaggccaaggcggguggauaauaaggucaggaguucaagaccagccuggccaacauggugaaaccccgucuccacuaaaaauacagaaauuaacugugcuuaguggcgggcaccuguaaucccaacuacucgggaggcugaggcagacaacugcuugaacccaggagguggagguuguagugcgucaagaucacgccacugcacuucagccugggcaacagagcgagacucuguaucaaaauaaaaaaaaaaagcauuaguggccagguacagagacuuacgccuguaauucaaacacugagaggccaaggccagcagaucgcuugagcccaggaguucgagauuggcuugggaaacauggagauacuccaucaauacuaaaaauacaaaaagucagcugggcaugguggugugcgccuggggucucagcuauucaggaggcugaggugggaggaucuccugaaccuggggagguugaggcugcagugagccaugauugugccauuguacuccagccugggcggcagagugagacccugucucaaaaugaaacaaaacaaacaaaaacacacacaaaacuuuaaaaagaaaaaggugaacagcuuucuaaaaaugaggaaggcuuugugcuuagaagccuaaguaauaagagaaaucagaggaaaugauugagauuuuaagcaccauaaaauaaaauuaaaaauuccaggcugggcacaguggcucacaccuguaaucccagcacuuugggaggccaagguggguggauucccugaggucaggaguugagaccagucuggccaacacggugaaaccccaucucuacuaaaaauacaaaaaaauuagccagguaugguggcaugugccuguaaucccagcuacucagggaggcuaagccagggaaauugcuugaaccagggagguggagguugcagugagccgagaucgugccacugcauuccagccugggugacagggcgagacucugucucuaaauaaauaaauaaaauaaaauaaaauaaaaauaaaauuauguaugacaaaaacauguugaacaaaaacuaaaaagaaaauggccaaccaugaaaaaaauaucugcaacaucuaugacaauggauuaaccucuuuaucauauguauaacuguaaaauuuacaaugaaaagaugaacacugaaagaaaaagcugggcaaaggacacaaauagaugacugaaaauacacaaauggcagaugaauaagaaaaaaaccaaaccucauuaauaguaaaagaaaugcuaaacuaaaauaaugugacagcauuugccucuguuaaacugcuaugguuguuuugaaagauacuccccagacugggcaugguggcucaugccuguaaucccagcacuuugggaggccaaggcgggcagaucacgaggucaggagaucgagaccauccugaccaacauggugaaucuccgucucuacuaaaaauacaaaaauuagcugggcauggcggcgugcaccuauagacccagcuacucgggaggcugaggcaggagaauugcuugaacccaggagguggagguugcagugagccgaaaguaugccacugcacuccagccuggcuacagagagagacucugucucaaaaaaaaagaaaagaaagaggaaaagaaaaaaaaagaaagauacuccccaauguuguccuuggugcagugaaacuagcacaauucuacugaagguaauugguggugugaaucguagacaucaaaaauagugcuuuaauacauaauauggagaaaauguuuguucuauauuuaaaaagggagggcggacaggagaggcagaauggaaucacuguuaagagucagagacgugcaucccaauucugguuuuucuaauuagcauugugaccuggggugagauaugcuaccuucucgcugcaguuuucuuuucuauaaaauaaggaaaugguacccauuucacaggcuaucauaaaaacccaaugaaacaauacaugcauggugccaacugccauccucuguauccuuauaccgccagccaagaagacauucaacaugguuaacucaacaauauaugcuuuuuuggcuucuuagcuuucuaauuagauuccuagaaucuaaucuuaucuaaaccuuugauaaauuuuccccacaaaaaugacuucucugauaaaguacuggauuucuguacgaugaagguacaaucaguugacagaagcuggugacugacuaaauccaggaaugaaggagaaagaguaaaaaagaaacagaacaagccagacauggugguuuguaccuauaguuccagcuacuugagaagcugaagcaggaggauggcuugggcccagaaguuugaggugagucaaaggaagggugggggagggugguaggaagagacagaacagcuuugcaggcuggccagucuuguucuauccagaauauugacgccacauuaaaccuuccugaaaugaggcucaaaaauuccaaaaauucaugauuggugaugcugacugaaucagguccaaauucuccaucuuagcucccagagcucuguacaguuuguucccauucccuuccacccacccaaccucaccuuugacuauuuccugcugggcaucuucuauaucaguaucugaugucuugucccuucccagcucaagucaccuucuaaaucaaagucaucucaaccuugaccaguacaaacugaccacaaguuuuaacuguagcauaauguucuauguguuuuucccccaguauuagcuuuuuaagggcaguaacuaugccuuuuguuucuguagucucuacagcaauggauacaaaacaguguuagacaaacaggaauucucacugacuuugucagaugaaacagguauagaugguuccugcacaggacaagagcaggaagggaacauggaaaaacaaaacacuguuuauaugcuaagugaaagccuaaguauacgaauuuaccuuuauugcucucuuugcaucacuauuuuuuuagugaugcgaaguuuuuuuacgcaucacuauuuuuuuagugaugcaaaguuuagaaacuuugaaagacaaaguuucauuauguugcccaggcuguucucgaaccccugggcucaagggauccucccacuucaucccccacaaaaugcugagaauauaggcaugagccacugcaacuagccugugucaauucuuacaccuuuuuuuuuuuuuuuugagacagggucccacccugucgcucaggcuggagugcaguggcacaaucaaggcucacuacagccuugacauccuggguucaagugauccuccuaccucagccucccaaguagcugggacuacaagcaugugccaccauacuugguucauuuuauuuuacagagaugggaucucacuguauugccuaggcuggucuccuaagcucaaguggccucccaaagugcugggauuacaggcauaaaccaccaugcucagccugugucacuucuuaauagagaaaaauaaaaauucccaaaaacacaauuacagguuagauuuuuuaaaauccugccauguaaaaauggaagcuaauugugaauacacuaauuuuugaagauauuaagguuuaguaauuuaucaccuaugauuaugacuacauagcaaauaugucagacaauuuccaaaggaaaacaaccaaaacaaccuuuuauacucaccacugcagaguuuagucaguuaaguagacugguuauuauacuaggaauaauccauguguacugagaauaagacaguagaagagaaugauuuccagcagucuauuuuauaacuaaacccacaacuuuuuaauauacugcuuacuauccauuauaaggggcaacugauugcuaaaaaccccaacuuauuuccuggggagaucagaagucuaucugcauucucuugguaagaaauacauuagcagcucuaagaccccaugaacuuucacaagccacagaaauucugaaagucaacaugaaggguaccuaacaaauggccuaacagagguugauacgaacccucagacaucauaagaaggcagagaacgcacagccauaaaaaagaaugaaauaauguccuuuacagcaacacagaugcagcuggaggucauuauccuaagcgaauuaaggcaggaacagaaaaccaaguaucucauguucucacuuacaaguggaagcuacacacuggguacacauggacauaaacauaacaauaggccuuagggauuaggagggggagggagaaaacgggguaagggcugcaaaacuaaucauuggguacuaugcucauuaccugggugaugagcaacaauuguacccccaaaccucauaaucacacaauauacccauguacacaaaaaaacuuggacauguacccccgaaucuaaaauaaaaguugaaauuguaaaaaauuuuaagagaacagaagauaccuugcaccuuucucuuuauauguauaaaauauauauuaaaaaccauauauuaaaauauaaaaaagauauacaaauauauaaauauaaaauauauauuaaacauuuauacauauauauauaaauuuuuuuuuuccagauggaguuucacucugucacccaggcuggaaugcaguggcgcgaucucggcucacugcaaccccugccuccagguucaaccgauucuccugccucagccuccuaaguagcugggacuacaggcacaugccacugugccccgcuaauuuuuguauuuuuaguagagacgggguuucaccauguuggccaggcuggucucaaacuccugagcucaagugauccacccaccucggccucccaaagugcugagauuacugacguugagccagucaccaacgccuggccucuguaaguaucuuuuuuugauguuguuguuuuugagacggagucucacucugucacccaggcugcagugcaguggcacgaucuuggcucacugcgacuuccgccuccugggcucaaauaauucuaaugucucagccucccgaguggcugggacuacaggcgcaugccaccaugccggcuaauuuuuauauuuuuaguagagacaggguuucaccauacuggucaggauggucucaaacuucugagcucuggugauccucccaccucagccuccuaaauuacugggauuacaggcaugagccacugugccuggccuuauuuauuuuuuuagacagauucuugcucugccacccaggcuggagcgcaguggcacaaucccggccacugcaaccucugccuccaggguucaagcaauucuccugccucagccuccugagcagcugggaucacaggcguacaccacuaugcccagcaaauuuuuguauuuuuaguagagacaggguuucacuauguuggccaggcuggucucaaacuccugaccucaggugaugugcccgccucauccucccaaagugcuggguuuacaggugugagccacugcguccagucgauagaucuuuacauuagaaaaauguugacugaaaagcuuagucugguauucucacuauacagaauguuaaaugacauuaggacaaggaggggaaaaaaagcaauuauaagucaucaggucgggcacaguggcucacacauauaaucccaguacuuggggaggcagagccaagagaaucguuugagcccaggaguucaagaccagccugagcaacauagugagaccuugucuccauuaaaaauuaaaaaaaaaauuagcuagguaugauggcauccaucuguagucccagcuacucgggacugaggcgggaggaucgccugagcccaggcugcaguaagcuaucaucacaccacugcauuccagucugagugacagcgcaagacucugugcccuuacugcccccccccaaaaaaaguaaucaguuuuuccugaggaugaaaggaaaagcuaaguaacuuuuacuagaugcaggacacuagccaaaacgaauaaaaguuauuaacucuuuuagaguaaaagcuagguuuaaaaguuaaacaaaauaaccauuuuacucugcuauuccugaaaacauauacgccaucaucuuaucugagagcuuaaaauacaucaaagcaaaguaucagugaacuaguaccaggaaaguuguagacuacaauaaagaaugaggaggaguugaauugggagaauaacuugggcugagaagcagaaaaauaauagugaccauuucuuucacagugacugggaacggaagcagccuuuaucugaaaaagcacucaucuauuuaaucacaacuguaccucucacuucucugacauuaauuuucauuuauuuuuugagacagagucucgcucugucacccaggcuggagugcaguggugagaucuuggcucacugcaaucucugccuccuguguucaagcaauucucagccucagccuccugaguagcugggauuacaggcacgcaucaccacgacuagcuaauuuuuguauuuuucguagagaugggguuucaucauguuggcuaggcuagucucaaacuccugaccucaagugaucugcccgccucggccucccaaagugcugggauuacgguggcucacgccuguaaucacagcauuugugugagccacccaguccagcauuuuuuuuuuuuuuuuuuuuuuugagacagagucucacucugucauccaggcuggagugcaauggugccaucucagcuuacugcaaccuccaccucccggguucaagcgauucucccgccucagccucccaaguagcugggauugauuacaggcaccaaacaucauguccggcuaauauuuguauuuuuaguagagacaggguuucgccauguuggccacgcugggcuugagcuucugaccucagcugauccacccuccucagccucccaaagugcuaggauuacaggugugagccaucacaccuggccgaucaccgugcucggccaauuuuuaaaagaacaguuagggccgggcacgguggcucacgccuguaaucccagcacuuugggaggccgaggugggcagaucacaaggucaggagaucgagaccauccuggcuaacacagugaaacccugucucuacuaaaaaaauaaaaauaaaaaauuauaaaauaacagggcuuuuuguauguguguguguagaaauaauuaaaagggaaaugaaaauguuucuucuaaguuaaaaaaaaaguuaagagcauucuaguauuuuguuaacaaucuccccucccauuuguuaauauuaaaggguauggucaaaacaaaacaauuauucuaacagcuacuugaagaaagcccacugaagcuuugaaucuaggaaauacguacuaauaaaauauuuguaauggcaacagugaaacuaguaugggaggaggggaaggaguucuuuugcuacaaagaauaauaaaggcuagacaauaauucuuucgccaaaagguggcugacgcugcuguagaaaggaacucucuucuuuaaaaaaaaaaaaaaaaguucuaacuguucuuuuucuuuuuuugagacggaguuucgcucuuguugaccagucuggagugcaauggcgccaucuuggcucacugcaacggccgccuccugcguucaagugauucuccugucucagccuccugaguagcugggacuacaaaugcccaccaucaugccaggcuaauuuuuguauuuuuaguagagauaggguuucaccauguuggccaagcuggucucaaacuccugaccuuaggugauccagccaucuuggucuccccaaaugccgguauuacaggugugagccaccgcguccaggcucuuuuucaaguuaauggaagaaaucggguauuagguguugaagcgucauuuggggcuggaggcagggaagggagagagaguacaagcauauguacuagggguagucuucaaucaguacugugcuaaagcugacucccagauaagcuuugucuucugcacgagguucaguucuuagggagcuccuugucuggcaggcagaaagaaaaacaaauagcagcuauauagugugaugaguacuguaacaacgguuaacauacuuccuaccacccuggcauaaaggaugacuucagugggugaagggcuuuaaggaaaggaauugcuacagcuggauaucaaaugaugagguggaccuugccugacaaacuacagaacaggugaacgguauauaacaaaaauauguauggaauuagaccaauuuugugcagaagaaauuuaauguaacugaguggaacuguauuaagccaucucaaauuaauauuauuauaauuauuuaucuuuuuuaagaggugcggucuugcucugucucccagacuggagugagcgcaguaguguaaucguagcuugccacagccuugaacuccugggaucaagugccucucuugccucagccuccuggguaguugggacacuacaggcaugcaccacugcacccuacuauuuuauuauuauuauuuuguagagguggggucuugcuuuguugccucggcuggucuugagcuucuggcuucaaacaaucuuccugccucagccucccaacauguugggauuaugggcaugagccauuacacccaggccucaaauuuauuauuuugaggcugggcacgguggcucacgccuguaaucccagcauguugggaggccaaggcggguggaucacuugagguuagaaguucgagaccagccuggccaacauagcgaaacccugucucuacuaaaaaaaaauacaaaaauuagccgggugugguggcgugcaccuguaaucccagcuacuugggaggcugaugcaugagaaucgcuugaacccaggagguggagguugcagugagcugaguucacgccacugcacucuagucugggguacagagugagaaucuguaucaaaaaaauauauauuauuuugaugugguuucagagcccucuguuaaggguagccuguuuauuucacuuauugaacauuuacaaagauaaugcucaucugugagucaacauuggugccauaguaccaacaggaggcugccucccaaguacaugcuguccucucucugcucuccauagcccaaaugacacuuuugcugguguagaguaaccuaagcuucacuuucuguuccccuaauaagagacuauguuagagaccaccagaucccuccuugccacacugcagacccauaucccuggaagcagcucagaguuagaccgucuuuggagcagcccuacagucuuuucaucacuuggaauaggagaaagacugagaaucuauagcaagucuaucaccuugaauaaauguauuacaaaauaggaauaaacuacacacacauaaugcaggauuuacacaacaccuaacagguacuuuuaugaauuuuggacagaugcugccugagcaaugauucccaaaccuauucuggugagcuuuaaaaaauauagauccuggcugggcgcaguggcucaucccuguaaucccagcacuuugggagaccgaggcaggugaaucaccugaggucaggaguucgagaccagccuguccaacauggugaaaccccgucucuacugaaaaugcaaaaauuagccaggcgugguggugggcgccugaaaucccagcuacucaggaggcucagucaggagaacugcuuggaccugggaggcagaggcugaagugagccaagauuacgccacugcaucccagccugggugacucugucucaaaacaaaacaaaacaaacaacaacaaaaaaacuacaaagccuaucucaaaacuaauauaauucucacauaagcaauaacagaauguaugacucaaugagucuuuugucuuuuucccccuuuuuguggagaauggggucuugcuaugucacccaggcagguccugaacuccugggcucaagcuauccuccugccucugcuucccuaagugcugguaucacaggugugagccacugugccaagcagaguaagccuugaaguuucacuucuauuuuggguacaaccaauauuuaacaaucucuagguaguaaggacaaucuguaggcaugaaagaagggaaaaagaaaaaaaaaaaacccugcagaaaugggcacacaugauagggugaacugucaugguuuuuauuuuuauaaauaaaaaugucucuguaacccaggacucaccucaugaaggcuacuuaguaaaaccaagacaacuuuuauuugguaaagggguuguccuguaaaguuaacauuaaaucagaagcuaacaguuuaaauaacaacaauggauacuuguaccaaauagcaaugugguaauaauaaauagcaauauaaugucuucgacaacaaucaagaaaauuauuggcugggcaggguggcucacgccuaccauuccagcacugcaggaggccgaggcaagaggauugcuugugcccagaauuuugaggcugcagcaagcugugaucaugccagccugggcgacagagcgagacccugucuccaaaaaaaaaaaaaaaaaaaaaaauguuuaagaaguuaccuacccuaaaaugacaucuuuagcaaguagcaggccaggcacaguggcucacaccuauaaacccaagagaugggacaagccuaagcaacauggcaaaaccuugucuuuacaaaaagauacaaaaacuagucaggcaugguggugcgggccuguagucccagcuacucaggaggcugaggcgggaggauugcaggcgcccaggagccagagguugcagugagcugagauugugccacugcacuccagccuggaccagaaagugagacccugucucaaaaaaaacccaaaacaacaacaaaagaguauagcagcauaagauauggauaauaaagcauuacugaauagcuaugaagaauaaaagaggcugaaaaaacaaagauacacauguagaaguuuaaacaacaaaagaaacaaaauguuacuuuguuuuuuuuuugagacacagucuggaaccuccaccucccaggggguucaagcaauucuugugccucagccucccuaguagcugggaauacaggggccaugcccaggaaauuuuuuuuuuuuuuuugagacggagucucacucugucgcccaggcuggagugcaguggcgcgaucucggcucacugcaaccucugccucccggguucaagcaauucucugccucagccuccugaguagcugggauuacaggcgccugccaccaugcccagcuaauuuuuuuguauuuuuaguagagacaggauuucaccaucuuggccaggcuggucucgaauucuugaccuugugauccacccgccucggccuuccaaagugcugggauuacaggugugagccaccacgccuggccuaauuuuuuguauuuuugguagaaaugggguuuucuauguuggccaggcuguucucaaacuccuggccucaagugcuccaccugccuuggccucccaaagugcuggaauuauaggcgugagccacugcacccagccucaaaauguuacuuugaaccaagaugauuaaaacaaguaauuugucaacuugguuacuucuuagaaauauugaaacaaacauguauaggcaacaaaaaaaugcaggcaauaccauaaccaagaaauugcauggggguaggguggagggcagggaggguuauauauuuauauacacccaaaagacacaauaaagacaaaggaagaagcaaauacuuuguugaacagggggacagggagaaaaaaauuacaaaccaagagucacuauuauuuuauacucucaacauaaccuuaaaaauuuuuaaauaggaguagaaagauauaagagauaaaacacaggaaauacuaaaaagaauuaggauaucuucuguuauagaagaguuauguaucauaccucuguaaauaugugauagugaccaugcuauuccagagauuuguuauauuagaguuuauuuaagcaaauaaacaaaaaguagugguuggaaaaauugaaaacuuucagugguccaagugcacuacauuaaaaacagaagugcuaaccaauacugccuguaaggauguucuguucuuaucacauaaagauuauugaaggauucugaaaaguccuggguuaagaagaugaguaagcucaaaaucuuauuagauacugaacuuuaauauuaucuucagucagagccuaguaaugcaucauugcacaugugggcaaacuuuuuuaaaguugguaacauuacugcucuuguugucugaaaaauacacacugaagacauguguaagacgggcacgguggcucacgccuguaaucccagcacuuugggaggccaagguggguggaucacaugaggucaggaguuugagacgagccugaccaacauggugaaaccccguucacuacuaaauacaaaaaauuagccgggcaugauggugcaugccuguagucccagcuacuugggaggcugaggcaggagaacugcuuaaacccaggaggcaggaggagguugcagugagccaagauugugccacugcacuccagacugggcaguaagagcaaaacucugucuaaaaaauaaaaaacaaaacaaaacaaagacaugcauacuacacccaagagcaauuaauguacagccucuacauuguuuuucuagacauacacauugaugcauguuuuucugucaaaagagauuuaaaaaaugaauguauaaaauaauuagcuacagaaucaaaugcagcaggaaauucugggaaacccaaagacuauucagagccagucuagggaagaacaaaaaaggcauaagcacuuguccuacauccaugaccuuaggugaaucacuuugcgucuuaguuuucuuaucuguaaaaugaagggauugacagaugacuuaaauuuucuuuuggcuuuaauauccuacaguuuuauuagguuaucaauuugaguaauacuuauagguaagaagggaaccaguaucaccacuuuacaguuuaaaaaaaaaaagaagacuggccagaugcgguggcucacgccuguaaucccagcacuuugggaggccaaggcugguggaucaugaggucaggaguucaagaccagccuggccaagauggugaaacccugucucuacuaaaaguacaaaaauuccaccacgccuguaaucccagcuacuagggaggcugaggcaggagaaucgcuugaaccuggggggcagagguugcggugagccgagaucgugccacugcacuccagccugggugacagagcgagacuccaucucaaaaaaaaaaaaaaaaaaaaagaagacuuuuuuuuuuugagaaggaguuccguucgucauccaggcuggagcgcaauggcaccaucucagcucacugcaaccuccaccucccaaguugaagcaacucuccugcuucagucucccgaguagcugggauuacaggugcccaccaccaugcccagcuagucucgaacuccugaccucaggugauccacccacuucggccuccaaagugcugggauuacaggcaugagccacugcgcccagcugaaggcagacauuuuuaaacgacugcacacagugaggcugcacacaagcaugaagcaaagagugguucucuggcuuugcaguccccuugucuguaacccagaaaucagacagaagucuccaaaaccuaguuuucgcuaugcacaccacuaaucgcuaaugcacaccacucuacugagcagcauuuacaucugcaguccaagaaauauaaagcagaaucccugugucaggcaaaaaugcuacaacauaaaauacaacuuaccagaaugcccuuuucucccuccauuaggauauguuuuaaacuagaaaagcugcccgaaagucaaggauuaaucacuguauacucuugcuuacuacucaccacacagagcaucaagauauaugcucuuuuguuuuuuuuuuuuugagaccaaaacucacucugucgcccaggcuggagugcaauggagcaaucuuggcucacggcaaccuccaccuuccagguucaagugauucuccugccucggccucccgaguggcugagauuauaggcaugccccacuacacccggcuaaguuuuguauuuucaguagagacaggguuucaccauguuggccaggcuggucuugaacucuugaccucaggugauccaccugccucagccucccaaggugcugggauuacaggcgugagccaccgcgccuggcuagauauauacucuuuuccucaaaaacccucagcaaccuaggacauuuuaggacucauuuccuccuuccuuauuggggaagauaauguguaucaucuacuucuuucaaaauaagaaguaggcugggcgccauggcucaugccuguaauccuagcacuuugagaggccaaggcuggaggaucacuugaggucaggaguuaagagaccagcauggccaacauggugaaaccucaucucuacuaaaaauacaaaaaauuagccaggcgugguaguuggugccuguaaucccagcuacuugggagguugaggcaggaaaaucacuugaaccugggaggcggagguugcagugagccgagaucgcaccacugcacuccauccagccugugcaacagagcaaaacuccgucucaaaaaaaaaaaaaaagaaaaauaagaaaaaaaagaaauuggagauuuaaguucagugugugaaaaauguguagaguauuuacagcuauauacgugauaggauaaucuacauagcuguuaacuaagacagaccucuaugucacccuaucuguaagucauuaaaccagcaaauaucuaccacuuagaaaacaagaacaggaccaaaaaagguuugauuaaaaaaaaaaucucaaagucuaugcacucaaauuuacaauaaacuuggcucucagagucaauguucauauuuuauuuaauuuauuuuuuugacacagagucucacucuguugcccaggauggagugcaguggcgcgaucucggcucacugcaaccucugccucccagguucaagugauucuugugccugagccucccaaguagcugggauuacaggcacccaccaccauauucggcugauuuuuauauuuuuaguagagaccgaguuucaucaugucgcccaagcuggucuuaaacuccugaacucaagcgauccguucgccucagccucacaaaguacugggauuacaggcaugagccacccugccuggccaaugcucguauuuuagaaauaauucaauuaaugaggaauagguagaaacaacauacuagaggcaaaaagucagggcaaacaaggacugcuaugcccaaaggaacaguucagaaaacuaaagcaugcacacaugccacuuaacauccaacaacaaaguuccuacuaauuugaaguaacagaagauuuuuuuuuuuuuuuuugagacggagucuugcucuguggcccaggcuggagugcaguggcacgaucucggcucacugcaagcuccguucaugccauucuccugccucagccuccccaguagcugggacuacaggugcccaccaccacacccagcuaauuuuuuguuuuaguagagacgggguuucaccguauuagccaggauggucuccaucuccugaccucgugauccgccagccucggccucccaaagugcugggauuacaggcaugagccacugcacccggccaacaaaagauaucuaacagaggcugugugagguggcucacaccuguaaccccagcacuuucggacgcugaggcagguggaucaacaucagcccagucaacaugacaaaacgcugucuccacuaaaaacacaaaaauuagcgcugugugcuauggcucacgucuguaaucccaacacuuugggaggccgagguggguggaucaccugaggucaggaguucuagaccagccuggccaacgugauaaaaccucaucucuacuaaaaguacaugauuagccgggugugguggugcacgacuguaaucccaucuacuccggaggcuaacgaaggagaaucgcuugaaccugggaggcggagguuguagcgagccaagaucgugccaccacacuccagacuggacaacagaggaagacucugucugaaaaagauaaauaaaauaaaaauaaaauaaaauaagccaggccuaguggagcaugucuguaaucccagcuacuugggaggcuaaggcacaagaaucacuugaccccaggaggcagagguagcagugagccuagaucaugccacugcacuccagcacgggagacggagugagacugucucaaaaaaaaaaaaaagaaaaagaucaucuaacaggaaaaacguucacaacacgcagcaagguuacaaaggaggaugcagaauaggauuccaaccuaauuaaaaauaaguaaggccgggccaggugcaguggcucacgccuguaaucccagcacucugggaggccgaggcagguggaucaggaggucagcagaucgagaccauccuggcuaacacggugaaaccccgucucuacuaaaaacacaaaaaauuagcugggugcgguggcgggugccuguagucccagcuucucgggaggcugaggcaggagaauggcgugaacccgggagguggagcuugcagugagccaagauagcgccacugcacucccgcgugggcgaaagagcgagauuccaucucaaaaauaaauaaauaaauaaaaaauaaguaaauccuggugcgguggcucacgccuguaaucccagcacuuugggaggccgacguggguggaucaccugaggucaggaguucuagaccagccuggccaacauggugaaucccugucucuacuaaaaaaaaaaaaaaaaaaaaaaauuuggccaggcguuggggcaggugccucuacuaaaaguacaaaauuagccgagugugguggugcacgccuguaaucccagcuacucuggaggccgaggcaggagaaucacuugaacccgggaagcagaggcugcagugagcugagauugagccacugcacuccagccugguggacaagagcgagacuucgucucaaaaauaauaaauaaauaaauaaauacauaaauaaauaaaauaaaaauaaaauacauaaauaauuaaaaaacuaagcugggcaugguggcucacaccuguaaucccaacaccuuggauggccugggaggaggggauugcuugaggccaggaguugaaggccagccugggcaacacaguaagaccccaucuuuacaaaaaaaauuagcugggccuggugauacgcaccuacacuccuagcuacucaggagcuugaggccagaugaucacuuaaggccaggaguucaagguuauagugagcuaugaucacaccacagcacucuagccugggcaacagagcgagagucugucucuaaauuaauuuaaaauaaucauuauaauuuaacaaacuagacaaacagcaaucccaguuaucccaccuuaagucaggacagcauuacaucuugcauggaccaaugcaauggccuucuaaacaguuucccugcuuccccucuugcuccauuacccaccauuuuucacacagcggccacggauuucuaaaauguaaauccauuaucagcaagaagacuucccuucugaaaccaccaugcugaaaacucuuaaaguccaaacucuuucacauggccuaccaagugcuucagggcccuaucagcagaucugcauccagccugacauacucgccucuaaucacacugaacuucuuucaguagccagaacauucuaggucuuuccuuuccugccucugggccuuuguacaugccauucccucuucuaggaauauacaagcaauucucuauguuuacacuaguacacgagccuaaagauguguauauaagaaggcuaucuacuacuaggguauuuuucucuaauggcaaaagauuaaaaacaagcugggcgugguggcucauaccuguaaucccagcacuucaggaagccugggcaguugggaggccagggcaauugggaggccgaggcagguggaucaccugaggucaggaguuugagaccagccuggccaacaugacgaaacccuguaucuacuaaaaauacaaaaauuagccgggcaugguggcaugugcccauaaucccagcuacucgggaggcugagacaagagaaucgcuuaaaccugagaagcaaggauugcagugagccgagaucacggcacugcacuccagccuaggugacagagcagcaagacuccgucucaaauaaaaaaaaaacaaaaaaaaacaaagauugaaaacaacucaaacgucuagaacaacguguauaguaagcuacuauuugugcuuuauuuuuuauuuuuauuauuuauuuauuuauuuugagacggaguuucacucuuguugcccaggcuggagugcaauggcgaucucggcucacugcaaccuccaccucccagguucaagcgauucuccugccucagccucccgaguagcugagauuacaggcgugugccaccacacuccgcuaauuuuuguauuuuuaguagagaugggguuucaccauguuggucaggcuggucuugaacuccugaccucaggugauccacgcaccuuggccucccaaagugcugggauuacaggcgugagccaccacgcccggccuuuuauuuuuauuuauuuauuuuugagacgaagucuugcucuugucccccaggcuggagugcaauggugcaaucucggcucacugcaaccuccacuucccggguugaagcgauucuccugccucagccaccugaguagcugagauuacaggcgccugccaccacgcccagcuaauuuuuguauuuuuaguagagaugggguuucaccauguuggccaggcuggucucgaauuccugaccucaggugauccgccugccucggccucccaaaaugcugagauuacaggcgugagacaccaugcccggccuauuugugcuuuuuuaaaaagauacauaaacuuggccaggcacauuggcucaugcuuguaaucacagcaauuugggaggccgagguggguggaacacuugaggccaggaguucgagaccagccuggccaacacggugaaaucccaucucuacuaaaacuacaaaaauucgcugggcauggccgcacauguguguaaucucagcuacuugggaggcugaggcacaagaaucacuucaacucaggagguagagguugcagugagccaagaucacgugucucacuccagccugggcaacagagugaaaacccugucucaaaaaaaaaaaaaaaaaaaaaaaaagauacauaaacucauacauuugaauauacgcagaauuuucuuuggauggauacaucagaaauugguauuuauugccucugaggaagaaaaaugagagaucagaggcaagacugaggauuacuuuucauuauuaacauuuugcacuguuugaaguauuucccccucauguucuuacauuaaauguggugguuacagaaaauuuccauagcacaauuauauuuuguuuaaaaaguuguauuauauguacaugccuguuaauaaaagugcaaagucaacacaccagacuauuaauagucuucagcucugggaaaacaaaguuaagggauucuuuagguucuaauguaauucuacaaucauuagacucuuccaaagaaugaaacuaaacauuacuuggguaauauuuaaacaaaguuuaagaccaaauuuaagugaggaucacugcaagaacugccucugcaaccucaauccccucuaacagcugggcagaugcaggagcuuccuccugccuuacucuccuccuggcugcacuucuauaacuguuccaguggcccucucgauuccacucaagaagucuagacuggcugggagcgguggcucacgccuguaaucccagcacuuugggaggccgagguggacggaucacaaggucaggagaugaugagaccauccuggcuaacacagugaaaucccgucucuacuaaaaaaaauacaaaaaaaaaaauuaggcaggcgugguggcaggcgccuguagucccagcuacucaggaggcugaggcgggggaaugacaugaacccgggaggcggagcuugcagugagccaauaucgcaccacugcacuccagccugggcaacagagcgagacuccaucucaaaaaauaaaaaaaaaaaaagaagucuagacauuacugccaaguaaacuaggcaaaaacaccuuuuaucauuucauuauccuuuuuuuuuuuuuuuuugagacagagccucccagguucacaccauucucccaccucaaccuccucaaguagcugggacuacaggcgcccgccaccaugccuggcuaauuuuuguauuuuuaguagaaacgggguuucacuguguuagccaggauggugucgaucuccugaccucgugauccgcccaccucggccucccgaagugcugggauuacaggugugagccaccacgcccggcccauuucauuaccuuuaucagaaaguuucagugcuacuuccuacuguacugcauucccuuuuccuuuaaaaauuaugcaauacaggcaacaggagaaagcuuaaagaaaccuaccuauagguuuuauacacacauucuggcuuauauccaaauucgcaguccccuccccaauauauacauauacuuacucucacgagaucauaccauacauauuguuugauaaucugcuuucuuuguacuuuguuucaaauaucuugccauuucaacauauuuuuuauacauaauggcuacacaacauucuauuauaaggccaggcacgguggcucacgccuguaaucccagcacuuucggaggcagaggcaggcggauuacgaggucaggagauccagaccauccuggcuaacauggugaaaccccaucucuacuaaaaacacaaaaaauuagcgguucuagcuacucaggaggcugaggcaagagaauggugugaagccgggaggcggaguuugcagugagcagagaucgugccacugcacuccagccuaggugacagagggagacaccaucucaaaaaaaaaaaaaaaaaaaaacauucuauuauagggauguaucauaauuuaaccagucaccuauuguuaaauauuuuuauagccagauuuugguaauucugcuuuaaucuaagaaaagaaaaaaaguauuugcauuaaaaaaaauuacacaaacuauacaaaaccaacaaaaagugacccccaaaccaaacuacccucacacuacuaguuuugacugaugauuuccacgucuguuuagucuuuuuucccuaggcauucauucauccaaauaauuacuuauugagcuucugcuauacgccagguuuuaguuugggauuuucuuuacuuuuauuccauaauaauuaacuuuuugguauuaugcuauuaaaaaaccucucucauaagcauuuugcugguuaacagccuuccguuuuuuuuuuuuuuuuuuuuuuaagacagggucucacucugucacccaggcuagagugcaugcagccuuaaccuccugggcucaggugauccucccaucucagccucccaaguagcugagacuacaggugugcaccaccacaccuggcuacauuuuuuuuuuuuuuuuuuuuuacagacaaggucucacuaaguugcccaggcugacauucaucuuuuuaaauggguuaggguuuuauaucccuugcaacaugcaacgagaccuuguuuucuuacccacuucucuacugcucaacagauuuucugauaaaucuaacccauuuuccuauggcacaauauuuccguuuaguucauuaacauuuguauuaucugguggucaucgaaguucaguuuaaugcaaaauauauacaauaaccaacuuggcugggcgcgguggcucacgcuuguaaucccagcacuuugggaggccaaggugggcggaucaccugaggucaggaguuugagaccagcccagccaauauggugaaaccccgucucuacuaaaaauacaaaaauuagcuagacaugguggcgcaccuguaguccuagcuauucaggaggcugaggcaggagaaucgguugaacccgggaagcagaggcugcagugagccgagauugcaccacugcacuccagccuggcgacagagcgagacuccaucucucaaaaaaaaagaggaaagggaagcccaaggaagucaccucuaauagaacugcccugcccaaggccauauagcuauuaagcugcauggccaggacuuggaguccuaaugggauuaaaauaaaauucauccucccaaagugcugggauuauaagcaugagccaccacgcccagccucagaaaacuuaauucuuacuuacuuauuuguuuauugagacagggucuuacucugucacccaggcugaaugaaaugcaguggugggaccacggcucauugcaaccucaaccuucucagcucagacgauccuccggccucagccuccugaauagcuaggacuacaggcaugcaacacaacgcgugacuaaagaaaauguaauucuuuuuuuuuccucuauccacaaggacauauggaaaaaauguaauucuuaaaugccacuuauguuaagagcaauauguuaauaacaauacuuaguaauuguaaaacacacaguuaagaauagaugcuuuuggcugggcgcaguggcucacgccuguaaucccagcacuuugggaggccgaggcaggcagaucaagaggucaggagaucaagaccauccuggcugacaaggugaaacucugucucugcuaaaaauacaaaaauuagcugggugugguggugggcgcauguagucucagcuacuugggaggccgaggcaggagaauggugugaaccugggaugcggagcuugcagugagccaagauugcaccacugcacuucagccugggcaacagagcaagacuccaucucaaaaaaaaaaaaaaaaaaaaaaaaaagaugcuuuuggcugggcguggugguucaugccuguaaucccagcacuuugggaggccgaacuggguggaucaccugaggucaggaguuugagaccagccuggccaacauggcaaaaccccaucucuacuaaaaauaccaaaauuagccaggcgugggggugaacgccuguaaucccagcuacucgggagacugaggcaggagaacugcuugaaccugggagggggaaguugcagugagccgagaucacgccacugcacuccagccugggcgacacagugagauugucucaaaaauaaauaaauaaaguaguccucuuaacaaacuggcaaaucuaaagaaguguuuccuugaggucugugaacugcuuuagcaaacuaauggaacccaagaaagaggucgugggaaacucaacuugaagccaguuggucagaagcucugaaggaaugggcuugugacugguaggaaggacagguggucuuaugggacugaacccuaaacgugugggaucugacaccaucuuggguagaugguguuggaugacaccuaguuggcauacacuguuuggugugugaggaaaaucccuccaccccaucuuuggucacguaagucuuuuuuuuuuugagauggagucucgccuugucgccaagccagaguacaguggcaugaucucggcucacugcaacuuccgccucccggguucaagcgauucuccugccucagccuccccaguaacuggaacuacaggcacgcaccacaacgcccggcuaaauuuuguauuuuuaguagagaugggauuucaccauguuggucaggauggucucaaucucuuggacuugcaaucugcccaccuuggccucccaaagugcuaggauuacaggcaugagccacugggcccagccacguaagucuucuuuuguguugauggugguuguuaugugaaagcaaaggaaaaaccugggcuugagaguuuuucccuacacaaauacuacaaggacaaaguaaggagcaggauagcagagcuguucuauagcucaaauguauugcuucucaaacauauccacuauagaaccuauacagagagaacuucccacccucaggcacucaugcucauuuuguugaagaccuauguuaucuuaaucauacaguuuucauucugcuccaaaaaugucuauuuguuuuaauauaacaauauuuaauauuuauuuauuuauuuauuuuuugagacggucuugcucugucacccagucuggagugcaguggugugaucuuggcucacugcaaccucugccugccuccugguucaggugauucuccugccucagccucccgaguaguugggauuacaggcacgcaccaccacacccagcuaauugucuucuugggguuuuuuuuguuguuuuuuugagacagagucucacucuguugccugggcuggagugcagugauuucaacucauugcaaccuccgccucccagguucaaacaauucuucugccucagccucccgagaaacuggcauuacagguucccgccacuacacccagcuaauuuuuuguauuuuuaguagagacgggguuucaccauguuggccaggcuggucccgaacuccugaccuugugauccgcccaccucagccucccaaaguucugggauuacaggcgugagccaccgcgcccagucuuuuguuguuuugggggggggggcgggggggggcagacagagucacucugucgcccaggguggagugcagugacacaauccuggcucacugcaaccucugcuucccagguuuaagcgauuuuccugccucagccucccaaguagcugggauuacaggcacccaccaccacacucggcuaguuuuuauauuuuuaguagagaugggguuuuaccauguuggccaggcuggucuggaacuccugaccucaagugaucuaccugccuuggccucccaaaguacuaggauuacugggauuuuggaggccuuggccuuccaauguacugggugugagcuaccgugccuggccaauauuuaauauuuaaucacugaccaguuaaauuacuuaacucaccaccuccucuaugacuauaacugaaguucuaggaagaugggucauguuuaucuuucuugugacuccaaguaccccgaaaucauaccaccugauucccuaaggguauucauaucccaguuugagaaacagggaucuaagcaauuaagcuagucauaacacuugaaagugauuaacguguuccuauaaacccauucccuaaacucuuaaagguucgauuucucaauaguuuuuaaaucagcaacuuuugguaugcacucugugucaacacuccuaaaagaaccugcagggcguaaguuauuuuuggagugacagaauacuaccacagaccuucuccuucccaucuagcaggauaacaaguugcccauuuggaaaauaaagguuugaagaauaacagaacuuucauuccuauucccuucucuuuauuugcuccaggcagagcuuguaagaaaaaucuuaguagucauuuagaugauucauucacauaagcuuaucuaauccuggcauuuguaauuuccacuucuacauuccuuuuugccauuacacauguacgauuaaauuauuuucacauuuuucuagggucugaaaaaaaugugcuuuccgguaccgugagaagagauaauuuuuacaaccagaaucccacuuuguuguuuaugagaucccaaagcauaguagauuccaauauuuauagaaggucuguuccaaguuccauauaauguccauuauauuuuauagcaaaaauuacaggcuaaauuaaaaugauaaucacugucacacucugacgcaaaaugggcaaugagcuaggcuaacucaaauuaagacaauuuuuauccaggauaccagguuccccaagaacaggauuccaucuguuucuuaucaaaauuacaaguagccacaggucauggacuuucuuuucaguucauuugccaauagucaaaauacacauuccaaggguuucuacagaaaagcagccacaauuuccugggaucuuucuauguacauguucagaauaguacuuaaagcuuuacaaaacacauucucauuaacggagaauagucucugagauuggugguguuauucucucacaagugaggacuacaggaguagacagguuaaaguaacuugccccauauuacccagcuaguauaucaucguaaagaguuucaaacccaggacucugauuaugaagccuguaugcucucaaucaccugauauccugcauccccuauauucaagaauuagccaacaaauccuccaacuccaggaggguuauauuacuaccauuuuuaagauagaaaaaauggaaauagcacuuaccucuccguggcugcaaagucaguuugaggagggaaaauagaacccagcucucaagccccuggucagcaaucuguccacuagcgcaucuuguucuuuggcuucagguccguaaucauucuaaaagaaaagcacaaaucauuuuaugaaacacuaaauucauacaaauacgcauauaguaugaaaaaaaaugagggaaaacugaagacagaaaaaauugggaaagaaacaaaacaccuguucaugucaugucacuaaccgagccauuccauaaauguccaccaucaagccaauaacaaaacauucauuuauuuuuucacacauuugcuaaauauauaaaggacuaaagguuucuaaguagcaaaauaguacuccaggcucacaccaguaaucuuaacgcuuucggaagccagggugggagacucacccaggaguuugaggcuguacugagcugagauugugccacugcauuccagccugcuugacagagugagagaucuugucucaaaaaaaaaaaaaaaaaaaaaggccaggcgcgguggcucaugccuguaaucccagcacuuugggaggccaaggcgggcagaucacgaggucaggagaucgagaccagccuggcuaacauggugaaaccccgucuguacuaaaaauacaaaaaauuagccgggugugguggcaggcgccuguaguaccagcuacuugggaggcugagaauggugcaaaccugggaggcagagcaugcagugagccgagaucgcaccacggcacuccagccugggcgacagagcgagacuccgucucaaaaaaaaaaacaaaacaaaacacuccacugcaauauugcaaccaaauaauggcacacauauucaaacuaccaaaaaauuaauuauuggcugggcgcaguggcuuacgccuguaaucccagcacuuugggaggccgaggcagacagaucacgaggucagcagaucaagaccauccuggcuaacacgugagaccccgucucuacuaaaaauacaaagaaaaaaauuagccgggugugguggcgggugccuguagucccagcuacucaggagacugaggcaggagaauggcaugaacccgggaggcggagcuugcagugagccgagauccugccacugcauuccagccugggcaacacagcgagacuccgucucaaaaaaaaaaaaaaaaaauuaauucuuauggcugcaguaauggcucucuaacaguuuauuuccguaucuuuagcaaguaguggucuuacugauuaaguuuguucaugccacaaguaaaggcuaugcuuuccaguuuaguaagauaacuggggaagccaaggcagguggaucaccugaggucaggaguuugagaacagccugaccaacauggcgaaaccccaucucuacuaaaaauacaaaaauuagccaggcgugguggcacacgccuguaaucccagcuauucaggaggcugaggcaggagaaucgccugaacccaggagccggagguuggaaugagccgagaucgcgccacugcacuccagccugggcgacagagcuagacuccgucucauuaaaaaaaaaaaaagauaacuggcaaaaggagcuuuuacugaccuuugaaaauccuagaagcauagcaaugaaacaguuuuuuuagucgaauaacggaauacuuuguuagauggcaucuuuucacccuaaauuacaaaaugaacugucaagcuucaagcaaagguagaguggaaccuaccucuaaagaaaaagaaagaaagaaagaaagaaaaucccaggccaggcacaauggcucacaccuguaaucccagcacuuugggaggccaaagcgggcggaucacgaggucaagagauugagaccauccuggccaacauagugaaaccccgucucuacuaaaaauacaaaaauuagcugggcaugguggugcaggccuguaaacccagcuacucaggaggcugaggcaggagaaucguuugaacccaggaggcggagcugcaaugagccaagaucgugccacugcacuccagccuggcgacagagugagacucugucucaaaaaaagaauaaaauaaaaucccaaaugaaauaaagagcuaaauuugaacuaaguguuuccaaauaggccaggcacagugguucacgccuguaaucccagcacuuugggaagccaaggcaggcggaucacaaggucaggaguucaagaccagccugaccaacauaguggaaccuugucucuacuaaaaaaaauacaaaaauuaaccaggcguaguggugugugccaguuaucccagcuauucaggaggcuggggcaggagaaucgcuugaacccaggaagcagagguuucagugagccaagaucacaccacugcacuccagccugggcaacagagcaagacucagucucaaaaaaaaaaagaguuuccaaauaauauagccaggugugauggcucacaccagcaauccagcacuuugagaggccacagcagaggacugcucgagccuaggaguucaaagccagucagggcaacauggcaaaaccccgucucuacaaaauacauaaaaauuagccaggcaggccgggcacaguggcuaacgccuguaaucccagcacuuuaggaggcccaggcggguggaucaugagguuagaguucgagaccacccuggccaacguggugaaacccagucucuacuaaaaauacaaaaacuagcugggcauggugguaugcaccuguaaucccagcuucucaggaggcugaggcaggagaacugguugaacccgggagacggagguugcagugggccaccaucgcaccacugcacuccagccugggugacagaggaagacuucgucucagggaagaagaacaacaacaaaaaaaaggccaggcaugguggcucacgucuguagucccagcacuuugggaggucgagguggguggauaaccugaggucaugaguuccagaccagccuggccaacauggugaaaccccgucucuacuaaaaauacaaaaauuagcucggcacgguggcaggcaccuguaaucccaacuacucccgaggcugaagcaggagaaucacuugaaccugggaggccgggguugcagugagcccagaacaugccacugcacuccagccugggagacagagugaacuccaucuuaaaaaauauauauauauacacguauacauauauaugccaggcaugguguugugugccuguggucccagcuacuuggaaggcugaggugggaggaucgcuuggggcaggugggggacaaggcugcagugagccaugaucacaccacugcacugcagugugggcaacacagugacaaccugucucaaaaaaaaaaaaaaaaaaaaaaaaagccgaguaugguggcucacaccuguaacgucaacacuuugggaggccgaggugggagacuugcuugagcccaggaguucaagaccagccugagcaacauaguaggauccugucucuacaaaaaaauaaaagaaucagcugggcaugguggcacacgccuauaguaccagcuacuugggaggcugcagcaggaagacugcuugagcccaggaguucaaggcugcagugagcuaugaucaugccacugcacuccuaucugggcaacagcuaugaucaugccacugccucaaucaaaauguauuaaaaaaaaaaaguuuccaagcaauuuggcacaugagguacaucuucuaagaggaaauccaucucacaauuagcuaaacuccacaaaacucacuaauacuuagaugaagcuaaagucuccucuguugagaggcaauuuuuaguaacacaaauaggugauuagcauauuuaguccaaccaacacuuccauacuggaguccauuauuauuaccagcauaccucaaagggaaugaaauuuucuaccccugaaaauuccaagagugaccaaaaacaaggaucaagugugaaagaauaccauccuaacccucaccuuuggacuguauuuuggcagucuauaugcaaugccacaacuuugcauucaaauauuaaaucacugagaaaaugcacaaagauacuagcaggaaagauacgaagacagacuacagaaaguuuacagguguuuaaaaaaaaugggcuggacacgguggcucacaccuaaucccagcacuuugggaggccaaggcagacagacugcuugaggccacgaguuugagaccagccuaggcaacaugacaaaaccccauaccuagaaaaaauuagucccagcuacccaggaggcugagguggcaggaucauuugagccagggagguggaggcugcagugagcugugaucacaccacugcacuccagccuggguaaaagagaaagacccugucuuaaaacaaacaaacaaaccccacaggccgggcacgguggcucacgccuguaaucccagcacuuugagaggcggaggcgggcaggucaggagaucgaaaccauccuugcuaacacggugaaaccccgucucuacuaaaaauacaaaaaauuagccaggcgugguggcaggcgccuguaguccucccagcuacucgggaggcugaggcaggagaauggcgugaaccugggagguagagcuugcagugagccgagaucgugccccugcacuccagccugguagacaaagcgagacuccaucuccaaaacaaacaaauaccccacaagaacaacaaaacaaaugugguaagacuaaucuuuuuuuuuuuuuuuuuuuuuuuuuaauuuugagacaaagucucacucugucacccaggcuggagugcaacggcacgaucuugacucacugcaaccuccgccucccggguucaagugauucuccugacucagccuccugaguagcugggauuacagaaacagacauaugccaccacgcucagcuaauuuuuguguuuuugguaaagauggggucucaccauguuggccaggcuggucucaaacuccugaccucaggugauccgcccgccucagccucccaaagugcugggauuacaggugugagccaccaugucccaccuacaaaucacaucaauugagaaccauggucuucaaaguuacacauuauuugccauuauuguucuuuuuaaaucauaaugcaucugaguuguuugaagaggggccuaauuuuuggcaaaacagucaagucaucuggagccaagacagguaaauuaggcagacagauggucuaguuuaaaaaaauuagguggagucuauaacguagaugauguggaauggcugugacagcagcagcaucccugaagcaaaaaaagcagucucuagaggugacuuuuggccaggaggcaccagccugcaaggcucugcccaggauuccuccccagggccuuaagucagccacaaguggcuuccaccaaggaacuccccaagccauucagaagucccaggugagugcccccauuugcguguguacuuuaaaauaaaauccuaaagcucuuagaauuugaaugcaucuuaaggacaacuucaccucuuaaauucuuacauagguugaauggaucccgauaaaguuaaccuuuacaacuacucuuuuuuuuuuuuuuuuuuuuugagauaagagucuugcucuguugcccaggcuggagugcagcagcacaaucucggcucacugcaaccuccaccuucuagguucgagcgguucuccugucucagccucccuaguagccaggacuacggcgugugccaccaugccuggcuaauuuuuuguauuuuuaguagagacaggguuucacuguguuagucaggauggucucaaucuccugaccucgugauucucccgccuuggucacccaaagugcugggauuacaggcgugagccaccgcucccagccacaacuacucuuaaauaggcaguauuuucuuaugcaggcaaacauuccuguuuuaaucauccuccuaucacuaauuuaaauaacagguccuggccuggcgagauggcucacgccuguaaucccagcacucugggaggcugaggcggguggaucaccugaggucaggaguucgagaccagccuggccaacaucgugaaaacccgucucuacuaaaaauacaaaaauuagccgggcgugguggcacgggccuguaauuccugcuacuugggaggcagagacaggagaauugcuugaauccgggaggcagagguugcagugagccgagaucgcaccacugccacuccagccuaggggacagaacgagacuccgucucaaaaaaaaaaaaaggucuggguuacccuaacauaucaauucauccucaauuuauucucuccguagauuguuuuuuaauaaaaacaaaacaaagcaugauuccuggcauaugggaauuucaaaggauagcaacuguguggaaaaggucuauuccacuaaaacagcauaaaugacguauaaacccaagaagcugaugacugcauaugaaacaaccaaaccaagaagcaaaauauggucuauggagcacaguacuaacccgggaaaacaagcuuuacuccuggcucgauuauacaccugcuguauuuuaauuuuuaacucaauguugagcuuauuuaaauaaauaaaacaugcuacuuaaccacaauuucaaaaggaaaacaaagucacaaaagaaugcaauaaauuacacaauuggacuaacauauuagauaauuaaaggugauucuauucccaagucuaacuaucaaucaacgcuacugcauuuaguuacucuaugcaauuuuauugaggaagagggguggcaggaauauuuugcaggguuccaaaaggagacauagaaagcgugccuacgaagaggacugcagugaggagcuacacauugagauuacauacaguggacuggacaacuuugguuaggaccaggcuguuuaauuucuucauaaacuuaacauagcuuccuuccuaaaaacagguuaauccagacuuucuucucuccaaaacaacccgaacugauacauuaacugcugcaaugaacuauauuaaggcacuagaauauuuacggaaaagcaaaagacucccgcaauucaacgggaugcuuuuuagugaagaaagaaaacuuaaggaccgaauaaauuuaaauauaugccuuguuuaacuuccuuucccaccuaugaggacuugguuuuuaacuuuccuaguugaucgaaacucaaaguaugaagacuacguaugcgaauguuuacuuaacgcugaacucggggcuacaggaagucuccuacuaaacaguaguuacauuaggcguagauauuuauaaaccaucugcagcaagugacccaggauucaauuacaacaucaacccucauauuucaucgcaugggcaaauuaccagucgagucaagaauaaacucauucugcccuacuggcgcucuagaucgaguugcacaauccuggggcagaaccgccuucaccuagcccuagagcaucagguacuaaguuagugugaggacauuuuaaagcgggagggaaacucaagggacuuagcccauacucccaaauucagaaauuugucacgucacuugagaucagaaugaaauuuaaguuucagucccuuugagaucucugagcgcacaaagucaggcugcuaucacucggcuggggaguccgaacccggcuggauaaaaacuacuuggugcggaacucgcaucuuuuccgcccaccgugggggggccgcaccggucggguccggccaggaacccgggcgcgaguuugggggcgcagcgggggcggcgagcgcgcguccccccgcccgcucaggcagcguagaggugcgagcagcucagccagccuugcagagggagcucucggcagcucuggggucccucugcucgcagccgcugcagcgccgccugcgccacucggcggagacggagaccagcggcggcgacgcgcggacugggagcgaccgccgagcagccaagcagcugggaaggcacgcaggccggcaggguagguuccggggacggggcuggcuggaggaggggcagcccgagacgcgacggccagggcccgacacccauacggcaccgggaccuggcuuagcgcgcggcggcagucgguccgaacccuuaagcuaggcgggcgccgaagccgggacgcggagauagugucucagcuggggccacccgccgcgggaggggcggaggacacaggacagagggcgggccgcggccgggcgaucggccggccaagaaccggccucgagggcagacaaaggaaggaaaauggagucgccgggcgcgcgggccucugccucugccgccgcccgaggccuagcgcgcugccaggagggaggccuagcgggcgggcgggcgggcgggcguggggguggggggggcggccgggccacggcggcgacgggcaauggcggcggccgcgccgcagcagggacgguagagggagacaaacaccccccggcggcggcgcuggcgccgggcugcagccagcgccgaccggagcggccccaucgugacaccuagaggcggcccgcgaaaccuccuccaccccgggcccccuuaccuccgcgccacaccccccgcggcgcccgcuccgccgccgcuccacggcuccggccacccggcgucuccggcgagcuccgcgcguccgcaccggccaccgccgccgccgcugccgccaaagaagcagcuccgcgcacgguuuaaucgcuccacaggcucagacacaaaauggcggcggcgcggugcagugcgccugcgucggcgcugccggggccgcgggugcugauaagggaagggacggguggggggaccggccgggcggcgaguagagggcgggggaggaaaggugaggggagggguuggcgcagggcagcauggg

SEQ ID NO: 193025 - RNA, 61294 nt, Homo sapiens
uuaggggcagaaaaacauuuguaauaauuaauggcuuugagagacacaaggcuuuguuugccccagaguauuaguuaacccaccuagugcuccuaaucauacaauauuaaggauugggagggacauucauugccucacucucuauuuguuucaccuucuguaaaauugguagaauaauaguacccacuucauagcauuguaugaugauuaaauugguuaauauuuuuaaaaugcuuagaacacagauugggcacauaacagcaagcaccacauguguuuauaagauaaauuccuuuguguugccuuccguuaaaguuuaaauaaguaaauaaauaaauaaauacuugcaugacauuuugaagucucucuauaacaucugaguaaguggcggcugcgacaaugcuacuggaguuccagaaucguguuggugacaagauuguucaccagcauaugguguggugaaaacucacuaauuuggaauuaguucagauuauuaagccugaauaggugaaaauccugaaaucaaggaucuuuggaacuauuugaaaucaguauuuuauauuuuccuguuguauucauuaaaguguugcaaguguucuauuugauggauuaaguauauuuaggauauacauguucaauuugugauuuuguauacuuaauuggaacaagaaagcuaauaaagguuuugauauggacaucuauucuuuuaaguaaacuucaaugaaaauauaugaguagagcauauagagauguaaauaauuuguggacacaccacagacugaaauagcaaauuuaaaagaaauuguuggaagaaucaaguguuuguggaaugaguccuccuaguaaaguuccugcucuugugaauaauuaagccucauguauaauuacuauagcaaaaggaagccuaagaaguauuagacucuacuuguauuuaaauuacauuuuacauaauuuauguguaugaaaaauguuuuaaaugcuuauuuucguaagccaugagauagcuccuuuauauuuuaagaauuucugaauuaauuugcuuggauuuuauuagugcaaauggcagagcuagcaauuccuuuuucuguguucccauuccauccuauucaucccucuuuuaggaaacucugaacucuggauuguccuuguuuacauaccugccuccugcauuggacuaugugucucugaguguaguaugacuaauucauuuguuugucaaggacucucaaugcauuuguugaacagccuaauuaguaaugucugcaacaaugacauuuuacuguauuuaauaaagcucugggaaaguaggauacacauaagacaggucuaggucuaaauucuuuacagaaacuuggauuuuuaguucgguuugaaauuugaagaugugaguauauuuaucucaguuucccaaaggacaagcuaauuggaauuaucauccucuuucacuugauuggauccccagaaugccauuuacgcaugcagcaggauuuuauaacaguuuuaaauucuguauauuugaugaagagguuuuauauuuuuggauucaagccucuuuuuaaacuucuacaauaugguuuacaauaauuccuuauauccugcuuuugaaauacauauuacaacuuuuuaaguuuggaaggcuauauuucaaggacugaaguuacaguauacucaagugauacacaagccuagcaccccacuuuccacauaguguucgauaaagauugauaaacucgaaaucacagaccuuuuaauucuuaagacaaauagcagcagaaagaaacaucuuuggcuuauuucugguaagguuuuuaugcucuguaaaacaaagaauuguauucauccgcgcagcacagauucuauuaaaaauaaaugugagagucguuaauguaguacugcucauuuaccaucaaaauucacuuuucaggaauaaucccaucaguuuaaauuggauauuggaaugagcauugauuacauuuaacuugguagcccaaaauuucuucaugggguuuugaacucggcgggauuucaaagguuuuaaaaaugaguuuuugauuuuuuuuaaaacccucaaauuucauuaccuuuaaacuaggucgaaacggggcgcaagagauuggauuaacaccauaguaauacuuauuuuguucuuaaccauuucagggcuucuugaaauagaggcuguaugguguaauggaaaaaacagccuuggaaucugggagccugauuccuggauucagucccaguuuugcgugaccuugggcaaguuacuuuacuucucugaauuuccguuuccuccucugcaaaaugaggaucgcaauagccaccuugcaaccuugacuggagcgagccucgcacaccccgcgccggccuggaggaagagcagccaugauuacgccgccuucgcuccgcuacccgcuugcggcuggcgcccuccuccagcagguguaggcgcugccgcgcugccccacgccuuuccgccgcucgcgggccugcgccucggcguccccgaggaggccgcugcgggcugagguagcgcaccggccucucggcgucccaguccggucccgggcggagggaaagcgggcgacccaccuccgaggcagaagccgaggcccggccccgccgagugcggaggagcgcaggcagcccccgccccucggcccuccccccggcccucccggcccucccuccgcccccuccgcccucgcgcgccgcccgcccgggucgccgcggggccgugguguacgugcagagcgcgcagagcgaguggcgcccguaugcccugcgcuccuccacagccugggccgggccgcccgggacgcugaggcggcggcggcggccgagggggccggucuugcgcuccccaggcccgcgcgccugagcccagguugccauucgccgcacaggcccuauucucucagcccucggcggcgaugaggcgcugaggcggcugccggcgcugcgccggagcuuaggacucggaagcggccgggccgagggcguggggugccggccucccugaggcgaggguagcgggugcauggcgcaguaacggccccuaucucucuccccgcuccccagccucgggcgaggccguccggccgcuaccccuccugcucggccgccgcagucgccgucgccgccgccgccgccgccauggccaaugacagcggcgggcccggcgggccgagcccgagcgagcgagaccggcaguacugcgagcugugcgggaagauggagaaccugcugcgcugcagccgcugccgcagcuccuucuacugcugcaaggagcaccagcgucaggacuggaagaagcacaagcucgugugccagggcagcgagggcgcccucggccacggagugggcccacaccagcauuccggccccgcgccgccggcugcagugccgccgcccagggccggggcccgggagcccaggaaggcagcggcgcgccgggacaacgccuccggggacgcggccaagggaaaaguaaaggccaagcccccggccgacccagcggcggccgcgucgccgugucgugcggccgccggcggccagggcucggcgguggcugccgaagccgagcccggcaaggaggagccgccggcccgcucaucgcuguuccaggagaaggcgaaccuguaccccccaagcaacacgcccggggaugcgcugagccccggcggcggccugcggcccaacgggcagacgaagccccugccggcgcugaagcuggcgcucgaguacaucgugccgugcaugaacaagcacggcaucugugugguggacgacuuccucggcaaggagaccggacagcagaucggcgacgaggugcgcgcccugcacgacaccgggaaguucacggacgggcagcuggucagccagaagagugacucguccaaggacauccgaggcgauaagaucaccuggaucgagggcaaggagcccggcugcgaaaccauugggcugcucaugagcagcauggacgaccugauacgccacuguaacgggaagcugggcagcuacaaaaucaauggccggacgaaaguaagugugugcugcggguuugugcuggacaggcccuucucggcgggcagccccugccugcgacugaaacugccuaggcugagaagcagcauuccucuauauagaagggacucgcucuuucuuguguagcuccccguaaggaagacggacagaauuuguaguagcuguuuaucuaguuagccccuuuguauccacuguuuuccacuuacugcccguucacaaacuucuccggcuaauugcaugguuuuuugacucaacguaggcgcuuuaacuuuccuauuuucuuuuuuccauuccacuauuggucacaauucaaaccuuaguggcguuuuagccacccagugaagggguguuagaguaccacccaaagcaaguccugguucugcaucugccuuguguuugcauaagcuguuaaauuuccuauggugucugaaccacucaucacauuucgauugagagucaaacgcuguguucaguuaggaauuugccggcugaccgcaaaaagguacauuuaaaauaagcauuuagucgaaagacucuguauucaggaagagcuuggcuacuccccucccccuguuauagcucuuaucccucacccuguuccuacuguuuugaaacccguuacaaaaaggggaaagaaguauuuccgucuucaggccucucaguguagguaggcuacauuuuuagcaccaguuuccuuuauuugcuuuguuaauguaauccuucuguugaaaacuguuuuguaacuuccuggaaaacaaaacaaaacaaaacaacaacacggaauuggcgcaggagggcucguuuuauccucccaauuuggugagaucuuuuuguuuucucuuuacuauugcgguuuuuccuccacagauuucuucacuucuuaccuagucuauucccucuuuccucccucaugauaaacaguagacucuuucguccuuaaccaacucucuugcagcucuuuuucauuuuacuucucagaucuugaucuuuucuuuguggcugcucccaggccacccuccuccaccaucagucucugauuuuguggguuuugagagauugaccugggagagcaucacaguugcauguuuguacacacacgcugacucuaacuagugguuuuucuguaugugugugucagaucaucuacuuugacagucauuacaugugauucucaggcugcccgaaagacugaacauaggcagugagaaaguuauaaacgugaacauuuuguggggaaaaauacaauguggagucuaauuuaccuauugccacuucauugcuggaugaaggcacaagucuuaauuucuuguagucuuaaaaaggaacaguugaauaauauuaaacuggaaggaaaagggggaucugaugaaauuucagcguuggucuuucacuagauuuucauugauaaaauuuuuaagaaaguugucagggcacaacuuuaagaaauugucacaucugaacauaaaguccugagcuccagagcaggaaagaaauuaguuugagacaauagggcugugaagacugaccaaaguauauaguugggacauaagcuuaaauuggauucuugaagaagaugaugucccaaaucuuucuugaucugcuuuccuuaguuaauuuagcuuuccaaguuaagcugagaccucuuuucucuuuugucuuccugcuuucaccuguccuuagagaagggacagcagacagccuggcucuuagagcaaaugcuucucauagagaugcuauuaggaaauagguaccuccuuccucaagaguucuaguuguugggguuuuaagucacguaacuguacauauuagcagguaauaagggacaggaugaaggagggaugaccuuuaaacucuuuggauuugaucugcuuauauuaauuuuagggacgcaacuucaggaucuauaaaugauauucaggaauuccuuucauuguacuucuuggcugaaagagguuuugguaaucguguuugaacauguaauuuauuccuaaaaaacaaggguguuugcuuuguggaaaugagaaggcaaucaaaauaaccacccaccguauauugagcaaccaaccacaguguguuaggcaucauauuaggaucaauacagauacaaucagaguauuuuuuuuuuuuuuuuuggagacagggucuugcuuuguugcccuggcuggaguacaaggguguaagcauggcccacugcagcuuccaccuccuggacucaagcuauccugccaucucagcuuccgaguagcugggacuguaggcacacaccaccauacuuggccaaaugaaaaaaaauuuuuuuuguagagucagggucuugcugaucauuugaucucgaacuccucggcucaggggauccuccugccuuguccucccaaaguacugugguuacagacuugaaccaccucaccuggccacaauaaucuuaauucugugaagugaguaguguuauuccuaauuuacauuugagggauuuucagcucagacuuggcagaggucuaccacuuacuauaacccuggcugguguucaaacuuaagucauucagauaucaaacccaugcucuuuuuuaacuacgcuaguuauagguagaacauuaaaugagauguagauuauuuagcacacugcuggaacugcaauuugauacauauauuuuguugaaagugggugaauagcacuagcuuuauaugugaguaaucauacucuaugguugggcuguguaaaacuuuuuauuaggugacuguacaauguuuauuucagauaguggcuuaaaagccacuuuuguauuuauccaccugaauuaugcgccugucaguauacuguuaacagaugucagaauaugguuuuuuuaugugauugcagagggagacuucaauucagaauuuuauccuucauaacauuauagugauuuuaaaaguuauaugcagcaaauguguaguauuuuucucauuucaacuuucacagcaguaggcaggugguuguaucccuuuuuuuauagauuagaaaagugggacucaggaaaaguuaguucacuuguuggaaauucugcagcauauuaggacuuaaauucagguuuucugacuaagaaucugauguucuuuuuuauuuacaucauguauauugcaugcucuuuaugucagggcaugguaaucagaugauacaugauagucuguggcccauucaguguaggcuuuguuuuccccugaauuucuacuucaaacaugcuuaucuggccgcuguuuaugcaacuacuuuaaaaaaggaaccauaagggaaaaaugaagucauacaggagaaaaacagaaauguaauuguagccacugauacaaccaagcuccuguuuccacuuucucuggucuuuuugggauuuucuccuuuuugccguuacccugcccuuugauccuauguccuugcuuaugcuuguuuucaucaagaagagucucaaugauaugcaguagaaagaaaccauggucugcuguuuugugaagaguagugugccuugacuuggggguacaggaggaagaggaaugcagaggagugaggaucaugggaaaauguugaacuuuucuguuggaguuucuucgccacuaugaaggaaaacauuuucccauuaaaauagaaauacuagaaucauauacauaacauuuuuggaauuuaauccaaaacuucaucuguuccguuaaaacauacauaaagaaaaggaguaauaaaauagguugggacuaauaagcagcagauuauauuacuaagauuuuucacuauuacuguaguuaauuaguuaggucuggcugauuauggcuuuuagagcaaagaauaggaugaggaaaaugcagcuguuuuauuaucacuaacagagauguggugaacaauccucuuagauguuaaaaacgaaacugacccaggaagagagcccucaucaguaccagaccaugcuggcauccugaucucagacuuucagcuuguagaacugugagaaaauaaacuuauguuauuuaaaccuaaauacauaaguacaccuuuaucuccuuuuuccauucucuuuguaugcuugggauccaggauacacaaauugaaguuacuuguuuaaugauuuuauaacuaugucagaauuuaaguuaaaagugaguuacucuguauguagaaaggcugaaaauaguacaacugcaguaauucugucagcuauaagggacguguggacugagaggguagucuuaauagauugugaucaacuauaugugaaaacauuuuguguagugaguugauguguaguuuacauguaaacuaacuccuuuaguucgaaaggaauuuuauuuuacguuaaaagauuauuuuaggcugggcuuuaguggcucacgccuauaaucccagcauuuugaggggcugaggcaggaggaucgcuugagcccaggaguucaagacuggcuugggcaaauggugagacuuugucucuaaaaaaauuaaaaaauuagccaggcaugguggugcgagcccauggucucaggugggaugauugcuugagcccaggugauagaacaaaacccuaucucaaaaaaaaaaaaaaaauuuuuuuuuuguauguauguaacucuuuacuuaucuacuaccuaauaauccacaaaaauacccacaaauccuuaauuacguggaggaggaggagaugauaauagagaucauuuuaacuuugaaagauaauggauuccgggccagaugugguaacucaccccuguaauucccaacacucugggaggcugaggugggacgauagcuugaguccaggaauucaagaccagccugggcaacauggcaauaccucaucucuauuaaaaaaaaaauuauuaagaaagaaaggggccaggugcgguggcucacgccuguuaccccagcacuuugggaggcugaggcggguggaucacaaggucgagggauugagaccauccuggccaaccaacauggugaaacccugucuuuacuaaaaauacaaaaauaagcuggguguaguguugcaugccuuuuagucccagcuacuugggaggcugagguaggagaaucgcuugaacccggcaggcagagauugcagugagccgggauugugccacugcacuccagcccgggcgacagagcgagacuccgucucaaaaaaaaaaaaaagaaagauaauggauuugguucugccauuagaucuggguuggauccugggucugcuaugguuucuguauccuuaguccaguuucuuaauuucuugagucgucaguugcuccguuuauaaaaugguguucagugauaccuguguuuuuagcuucucaggcuuguugugaggugaacauauaauguuucauguaaagcaccuuuuagaugguaaagcgcuaugcagaacuguucuuaacuauuacuucucccauuuaaaaaauuugcuaucuuucugauucuuuuaagaauucugugcuuucccugucucauuccccuccgauaaacuggagaaaaaagggcuuagaaugaucacccauuuuuuuaccuaaccacuuuuccugcauuuacacauuuuuuuuuaaaagagaagaaauaacauuuuuuuaagagaaaaaagucccagagagauuaacuucuucaaggucauagagcuggugacaaaaucaacagaccuuugauuuaguucauucauaucuguaacuuuauacauauuucuacuuaacuaauuuuggcauauuuuacgcuuuuuuuuuuuuuuuuuuaaaggacagggccuaacaugcccaggcuggagugcaguggugcaauuauggcuuacugcagccuccagcuccugggcucaaacaauccucccacuugagucuccguaguagcugggacuacaggcaugugucaccacaccuggauaauuucuuaaauuuuuuuguagagacgggaucucguuauguugucuaggcuggucuagaacuguuggccucaaaugauccuccugccuuggucucccaaagugcuggcucaugccuguaauccuagcacuuugggaggccagggugggcggauuugcuugagcccaggaguuccagaccagggggcaacguggugaaacccaucucuaaaaacaauacaaaaauuaaccaggcaugguggcacaugucuguagucccagcuucuugaggggcugaggugggaggaucgcuugagccugggagguagagguugcagugagcugugauugcaccacugcacuucauccagccugggugacagcgagagccugucucaaaaaaaaaaaaaaaaaagugcugggauuacagguaugagccaucgcacugggccucugccauuuuugagaauaugcuugaacauucgagacuuucuucucccuuuugcuucugucauucuacauguuggcuuaucugacauucuaguuuaaauuuuucuccuaccuaauuuucuuaaauguucuuuauccaucugucuuuccucugauacuauuuaaagccguuugcccugaaguaggccuacccucucuuguuucuuuaguaggagcugucuucccacucuguguuucugagugacaguuuacuccuguuuuccuuucccuuuucucucccaucaggcuugaaaucuuuguucuucuuccauguuuucugaagccugugccuuucugauaugccuuuggauugauguugucagcuuaguuguuuuuguuuaauuuuucacuuuaggccuuuaaagcuaccccaacuauuucagucucccuuuuauucuagcacauucuugggcaguuucuuuuucuuagauuuuacuucugugcuuacauuccaccuucuuuuccacugugcccucguuuccacacuuggaacauugucugugacuacaugauggcauucagauaauuuacuaaguccauuuucagagcuugucuuugccuuuuauuucagcuaaaucucuucuaaaaaaaaauugauauagaugguuaaccaaaaucuucucuuacaacaguuuauuucaugccuuauuucguagucaaaacucaacuuuucugccaccuuuguacuucauaaucacauuuuuccauaaccaauucagaauuaguuucauuucugaagagcuuggacagugucuguugacuugagauccccauaaaguuuucaugaguuuggaauucucuuuuuucuuauucaguguuccaggucccauuucuuuaccaaagcaaaauacguguacucuuuacccuuuguuauauuuucugaguccuguuuugauacuauuuucacucauuuguucauucaacaaauguugaguacccugcacauacaggcccuguucuaggagcuaggguguccugaauaacaacaaaaagccccccuucucauggaccuuaucuucuaguuggaggaagugugggguggggagggacagucaauaaacagauguacaaguaauacauggcacguuaggugguaaauauuaagauggagaauaagauaaggacagagugacuagggaguacucuuuuagauaagauugguaaaauaaggugacauuuaaauagugacuugaaugaagugggaaauuaguuauguggauauguggaagaggagcauuuucaggaaugguauuaaauagcaaauacagaggcccuaacuugaaauguguuugguguguucagaaaacagcaagcacggcacuuugggaggucgaggugggcggaucacuugaggucaggaguucgagaccagccuggccaacauggugaaaccucaccucuacuaaaaauacaaaaauuagccaggcgugaugacauccgccuguagucccagcuacucuggaggcugaggcaggagaauuacuugaacccaggagguggagcuugcagugagccaagaugaugccaccgcacuccaaccugggcagcagcgugagacucugucucaaaaaaagaaacagaaaacagcaaggaaaccacugugguuuuaguggaaggaguaaaggauaugugauugauguaguaggauaggaaaugagaucaguuuguguaggauauauucuggauauauuuugaaaguagaaucaaaugagauuugcugauacauuagaugugggguaugaaagaauggaagagucaugaaugacuuaaaggguuuuggcuugagcgauuggaaggaaauuauuguuuuauuuugaccuaagucuucugcuuuucuucucuugcccccacuuuuucaguguugccauuuaugauagcuugcugacacuuacuucccagccaagcaacaagaaaaaaguuauauguucuauauuuucacauuccuucaaauuggcugugcuagcuacuacuacuguugaccuucuagccccauccuuucuucucuagagguuuuaagguuucucugugcaguaugcuuguaucagcucuaccaguggaaccgccuucaggaauuauugcaggaaaccuugcaacacuuuuaguguugucuauaaguaugucugugcuuccuugcaugaaccacucauucaagauggcuugugaauccacguaaaaagaaauauacgaaguuugaacuuuaggggaacauuagagaaaauugaaugguucaacauaagggaagcauagauuuagauucaaugucaaaaugaagucagaaauaaaacaucuucauuuaaaccuacuguugaaaauaaaacuguuacagaaaauugggaagaauggaauuaccguaaaauaucaaaaauaguuccacugacuuaucaauacaugacuguaugauacacaugacuauaugauagcuuccuaaaguagugaagaagaagaaaguuacugauagcuuagggacuguauuggaugaucugugaagauaucaguguuguaugagccuuucaucccuuugauguggagccuggcauuggaauugcaaauaaaaguaccaaauauaaaauaauacugguacuauuaaaauuagaauauacuauccaggccuuuuuuuuuuuuuuuuuuuuuuuuuuuuuuuuuuuuuugagauggagucucacucugucacccaggcuguagugcaauggcguggucuugguucacugcaaccucugccugcaaccucugccuucuggguucaagugauucuccucccucagccuccugaguagcugggacuacaggugcccaccaccacaccuggcuaauuuuuuuguauguuuaguagagacaggguuucauuauguuggccgggcugaucuugaacuccugaccucgugauccgcccaccuaggccucccaaagugcugggauuacaggcaugagccacugugcccggccuacuauccaggacuuuugagcauaggaagccuugcuuuugauucuaaagugagagagggucacaaaaguauggguaaacauuagauugucagguaugaaauaauuuuuaaaaauuaaaaccagaaacaugaaacaugaacuccagaacccaggaagcuguaaucucaucucaauucaguuuaaggcuaauuuuuauguaauaacaccuuaauaggaaaugucaaaucuaagaaguaaauugaaaaggacuaaucauaaguuuggggaauaaaaagauugaccauuguguuugucuguuuucacacugcugugaagaccugagacuggguaauuuauaaagaaaagcaguuuaauugacucacaguuccacauggcuggggaggccucaggaaacuuacaauuauggcagaaggcaaaagggaagcaaggcaugucuuacgugacagaaggaggcggggagaauugucaaacacuuuuaacauaagaucucaugagaacucacuaucaugagaacagcaugagggaaacugucaccaugauccagucaccucccaccaggucccuccccugacaauggggauuauaauucaauaugagauuugggugaggagacagagccaaaccauauuaaccaucucucugaauuuuuucuuauuaauauugauauuuccaauuuuccucuauaaauggugacuaggagcuuggcuucuauaguuuuguuauauaauuacccuuuaauucuaucucaaggcauauuuuaccugugugaugucuucuaccaauuucuguuaggucuacucugaaauggaugccuugaaaauugcuuuuuagcuaaaaaauuuagugauuccccgccccccaccccuuagaccagauauuuuuacugcugcaauagcucuauuaaccaccccaccuuuaaaaucuuuggcuacccauuuacuagccugggucuuauccuuucaguuguuuuuucuuauauuuuucaguuuucuuuuuuuccucaacuuacaaugguaguuuuuuuuccuaaaguucaguucacuuucuguucaugacugucagaagauguguauguagaaggaacuugaacaucuauauuucuagauuuuucuucuuaguuuguaguagucauuuauugcuacauaacagauuacuccaaaguuuagcagcuuaaaacaacacacauuuguuaugucauacuuucuguagacaaggaauugggcacagucuagcuacaucuucugccucacuauuucucacaggcugcagucaggacauuggucaggguguguggucuccuucuaaggcuugaauggggagggaucugcuucuagccucacucagugguuauuggcaccauuaaguucuuggcagguuguuggacugagggcuucaguuucuugccacgugggcuucccuaacaugacagcuuucuucaauaaaguaugcaagccaaaaaggcaauagugucugcuggcaagacugaagucccagucuuguaaucugaugauggaagugacaucccaucacuugugcuguauucuuuugcaagaagcaagucauuaggugacuuuccauuccauaugugugaggaaucauacaagaauauaaauaccaguucuuacgucaguucuuccuuggcagugucugccccuuaaauguuacuauucuuuaugaucugugguuugucuucucuuuuuuucccucuagucuacacuuuuuuucccccuggguuaucuuaugcgcucauggaagcacaaguucuuaaacuaguuugccuguguugaagcucuucugcuacuuaauugcucucugauuuuagacacauuuucuaaccuaaagcauuaauuuccucaucaguaugauaggaguuaauaacaguacuuaauccaauaggucuauuugaggacaggugagaaaauaaagaaauacucaacagauaaucagugcucaauuaguauuagcuguaacuguaacaaauaauaguaauaacaacaaucaugacuucagcuauuaggauuuguuaaagauuccuucgucugucucuuacuuuggcaucuguagaggacugacagacauuucuaccugaauuuucuggaaguauugcaaacucaaugugauuaagacugaaguuuccucuuguuggaaggaaugaggauugguaagccugucugaugggggagauggaggaacagauuuaaaauugauccugugaacuucauuuaguuauucaacagcuauuuacugagugucugaucuguguuaggcacugaagguaccacagugcccaggucaaaguaauucucucugccuuucuggagucuuaacugugugagggaaauacaauguugaaccuguaauucccagugcuauguuuaugagauggaaguacaggauccuauugggaucacacaagaggagaccuaacuuggucugcaggccaggagagguuuuuuuuuguuuuuuuuuuuuuuuaagaaauuaggcuaagacuucuaaagguuaaguuggaguuaagucuauugaaagucuccaagucuggaaacagcaugauguuuuagaagaacauacuuuccuuuaucaguuugaaaauuuugcuuauuuaaaacuaauuuccuauuagucucuuguuccucauucccauuuacacucuucauugcuguccuggauuauuacaaaagccuguuuguuuguuuuuuuucuuuuuguaucuuucuaguucauucuguccauugcuacuuuuuuauaaagaacauuucacuaccauauacuuucuguuccagccacaggaaccuguuugcaggucccugaaccuaccuucauuuucuagugcugugcauuuccucauuucuuucguuuggaaaguggugagaagguccucuaacuugcuucuugcccucauuucucuaagcagagcuacaacuuuguccugucuguuccucuggcacuucccaucaccgugauagcauacuucacuguggcugguuuccauucccauuuccucuacuauagugagccacuugaggcgagaacccuuguauuuccaacauugguguacucagcaucuugcgucgaggacucaguaaguauuauauuugaauucccacugcaccgcucuaauuagaauuuuaaaaaucacuuucuaucuggauuguuacacacuuuuuuuccccuuaauucauuuuucuccauguacuacccauaugcauccuauauaaauuuaccaacacucauaaaaaucuuacucagaaaucuucagagguuugcuaaggauacaauuugauucuuacacauuuaaugcucaccagcugcuuaggcccacaccauuuauccacccugauuugcuacugcucuuugaaauacaaccaguguuucagccagacuguuuuccugcuucugcuccccuucuccuccucccagcacaucugugaauucuuugacugguuuaccacucccacacuccuccccagcaaugcagaucuucuacacccuuuaggaucuaagcuaagucugcuucccagauauccucccgaacucugaauguccuuugaucucucuuuucucaaaaaccuuuuauaccuuuuauucccaaauuaucuucucuagaaaucuguaagggcaggggaaggaaagguuuuauacuauucugucuucggcagaggacuuuuauuauugcuuguuacguacaguauuagucauaucuugcuaacacucagugaacugcccucagcugauccucugcccuguaccucaccucugcuuuaccaccuuuccauccgauuucuaaaacuguagugggacuuuuuaaaaagugugugagaguuuuaauccuguugugguaaacucgccuuucuuugcuugcuauacuguuucuagucccuauuuuccagauaaaaauagcccaggucagcauggcuugcacuauuuuuaacuccagguacuaggagaaagguuugcucuaaaggugaaaugaaguuuuaugacguugcuuaggccaaaagucaguugaugagguuaugaacugcaauagaacuuuacacauccaugaaucuaauggagagggccugcauaucuuaugucccucaccccuaccaauggugugugaauccuucaaaacaaaacagcauaauagacauaauguugaaagugacuucuuuauauacccuuuuuauaagaccuagaagaaaaaagcuuguagcuagaaagcagaugcaaaguucaacauugauaccacguugaugugcagaguaaaauuuucaagagcaaaauuuuaagcuucuaaaauuaucauggauuugauuugguuuucgaacuguaauuuacucaaaaugucaauuacguggaaggagguuuaagaguuguauuuaacaaaagagggcaugaguuaauuaaguugagaaauauuucuuuuaugaugagaaaaccuuuuggccuuaaccacauuucuagauucaaggauuuaaucaacgugggagaagcaguugcuuuaacuagauuaaaagagggccaugguggaguguagauaaauagaaaucuggcaguguaaaggucauuugaaucugguuuucucacacauucaaacauuuuuauccuuaaaacaaaaauggcaguuugaccugccaguuuugcuuaguuuugaugcuuaaaauguauuuuuauucucugauuacagaguugguaaggaaaguagccuaagaaauauuuaccacagaugauuuaugugcaaagagugguuguaguuuugggugguuacaacccaaaguauuuuggaauaaaaugucuugaauaaagaaauuuugggcuaaaggucaugugugauaauaaaauaacacccuuuuccgauagcuuagaaguuuuuuccaaggcggucauauaagcuagcgucucacaacuuuguuuugcugcuggaccccuuucagaaucuagugggagcggugcacuuucucacacucaaaaugaacauaguacacacaauguucugcuuguaauaaagccccuccauagacccuauguuaaaaaccccguuagaguuccaaaaaaccauaccaaaacuaaacauuuuuaagcauuucauaucacguuaugguagaauaagguuucuguguguguucaguucuugcucccucccugccuuuagaacuaugguuugaguuucuuuucccccauaaauaaugguauguauauccuauggacuucuggaagauauaugccuuauacagucuggcuauagaacaaaacaaaguuaaccgguauauaccaggauggaaacuaccauauagugauaaugucuucucuggagggcauaccucuccagacacauuugcuagguuaauucuugcuuuagaauucuagaugugcaguuguaccauaaaagacugagagucuuuaucacuaauaauuaacacuggcuuaugauucucuuuuuccucuuguccuuuuaacccuguccuguccccugcucccacugccucuguucucguuuguuuugcauuuuuguuuuuccuuguaacuggcauuucaguaguauuaaccugaaauuuuuuuuuuuuuugagacggagucucucuggcucugucgcccaggcuggacugcaguggugcaaucuuggcucacugcaaguuccgccucccggguucaugccauucuccugccucagccuaccugaauuaaaaaaaaaaaaaaaaaaagccuuaguaauaguagugcuccgcggcuggggaauugggugggggugggggguggggggugcuuacuaacuaaaaugaaacuagaauucauacuaguuuuuuuauauuaaaauaguuucuauaaugguuagaucugaaacaucucuggauaguuuugguagaaaguaucugcagaauauggaagaauaauuuguucguauugacaauuuucaggaacuaugcuuugauguugcauaguagcuguaagcuuuuucuuuaaugugugccuacucuagagauucuugguguuucuuccucuuagaauugucuggggaaagggagaacaguagugugggguggggaagauguuuguggacagaagccaggaaugggaauaggaccugcuaguauugccuuggauucuugucaucuggcucucuacuacugagcaaggcacucaacaacucugccagucucuccaucuaugaaaugggaguaaugcugaccuaauuaacagaagaguuguugaguagaugauuauuuguaaaagacuuuuuaaaaaaguaguuauauuggcugggcaugguggcucacaccuguaaucccagcgcuuugggaggcugaggugggcggaucacgaggucaggagaucgagaccauccuggcuaacaugguaaaacccugucucuacuaaaaauacaaaaaaagccgggcaugguggcgggcaccuguagccuguagucccagcuacucaggagacugaggcaggagaauggcgugaacccgggaggcggagcuugcagugaggccagauagcgccaccgcacuccagccugggcgacagaacaagacuccgucucaaaaaaauaauaaauauaaauaaaauaaaaaguaguuuuauuucucagcagugccuuuucagauuaggacuuggucuuaguugcccuuaacucuguucuugguguugguuaacauugucaucagaaguucagauucaauuuuagauucagaauucuugacuugguuuuacugggaugucagaaccuuauuuuuaauuaaagcgaaucuauuguugcuuaggcaguuggcacauagauuuggcacugugagaaaggaaauaguguucaguugauaagggcaucuugaacugaauuucagauaguuguguuacuuaauggguaaugaaauaacuccagcugaggaacaccuugauuaaaaaaucuuucucuccucaugccuucuccguuagcagauugaagucaaguggcaauauuuuauuuauaaucaugaauuuaauuauuuaagcuauauuaaaaaaauugaaacccuuagauguuaauuaauuuuaaaaacuagugauggaugcagguaagcuagaaugauuggaucaaaucucacacacaaaugaguuuauucuuuaaaaaaaaauuuuuuuuuuagagacggggucuugcuauguugcccaggauggucuugaacucaugaccucaagcaauccuccugccucacccuccugaauagcugggauuacaggcaugagccacugugccuggccuuauuuuacaggucuuacugacguaagcccauauuugauuuguuuuacaguuuguugauauugcuuaguauuucuuuuauuuacuguauagucuauaacuuaauagguagcaguaaaaacaaaauaauaaaaguuauuuauuuuccuccuaaaauaaugggggguauuuauggcuuauuuacccuuaauaaugucuuuuaaguggccauuauaaaauauguagaauuacuuuggugucugugcugucaaauuuggcucauguaguaauugugcucguaguaaaaaguguauuuuaagcagccuguguuguccuuaagaaauuucauguagguuccacacuuuuuucuaaaauuaauuauucuuaacauuuuuaacagucaaaacuugaaaccauuaagaugugaacugcuguauguauuauaauagggaguagcuuuuuuaguguugacauuguauaaaauuaguuauuuacaaagauaguaaagcuuauuguuugaaaauaaggaauugaggaaaugaaguuaaacaacauguauucauaccuauguuuuucuuauagaaauauauaauaucuagguauguagaaauguaaacacuuugaauuauacaauacuuugaauaauuuaauaacaauauagcuuaaauacuuguaguguuaucuuuucaguuugggaauugcauauauauuuuaacuguaaaaaucuuuuuuuuuuuuuuuuuuuuuuuuugagauggagucuggcucuguugaccaugcuggagugcaguggcucacugcaaccuccaccucuucccagguucaagcgauucuccugccucagccucccaaguagcugagugccaaguacaggcacgcaccacugggccuggcuaauuuuuguauuuuuaguagagacaggguuucgccauguuagccaggcuggucuugaacucccaaccucaggugauccaccucccuuggccucugaaaguucugggauagcaagcaugagccacugcacccagccuguaaaaaucuuacaugucaugggaaagaggcugcugcuuuguuuaugacuuuauauaguuucugauuauaaaaauaauacagugcuccaaaguagaugaagcaaaaucugauagaaaugaaaggcacaaucaacaaauuacaauuauagcuggaaauuucaauacuucuuucucaguaauucuuaaauaggaaaucaacaaggauauaaaagauucuaacacuaucaaccaauuugaccugauugacaucuguagaauauuccuugcauuaacagcauaaaauacguuauuugcaaguacauaugagacauuuaccaagguacaacaggugcuaggccauaaagcaggucuuaauaacuuaaggauugaaaucauacagaguauauucucuaaccacuaugaaauuaaauuagaaaucaguaauaaaaugaaauuuugaaaaucucauauguggaaauuaaacagcgaauuucuaaauaaccuaugggucaaagaagaaauagauguagagcaaugguacagggugaagaguucagaaauagaccuacacuaacaauaucaauugauuuuuuuuuuuuaauaaagauacuaaggaaauucaguacuggcuagguuuuuguucuuuuuuuuuucuucuguaaaugguuuuggaauacauggcuaucuauguggaaaaaauaaaccuugacccuuaugucccaccauuuauaaaaauuaauucaaaauggaucacugaccuaaauguaagaccuaggcugugugcaguggcucaugcuuguaaucccagaacuuugggaggccgaggccggcagaucacuugaggucagggguuccagaccagccuggccaacauggugaaacccugucucuacuaaaaauacaaaaauuaguuggaugugguggcgugcaccuguaaucccagcuacucgggagggugaagcaggagaauggcuugaaccugggaggcagagguugcaaugagcugagaucgcaccacugcacuucagucucagugacagagugagacuccaucucaaaaaaaaaaaaaaaguaagaccuaaauccauaaaacuuuaaaagaaaacaucagagaaaaauccuugugaccucaagauaagcaaauauuuuuuaggacauaaaaaagaugagccauaaaagaaaaacacugauaaauuagaccaugucaacauuaaaacguuuugcuuauccaaagauaccauuaagaaaaugaaaagacaaacccuuuugagagaaaauauuuacaagcauauucaacagaagacuuguaucagaaugucuaaagaauguauuaauaagaagaagagaaacaacccaaaagaaaaauaggcagaaaaauugaacagcuuuuucacaaaagaagauacaggaauggccaagugcaugaaaagauucucaacaucauugguuaccagaaaaauuaaaaauuaaaaccacaaugagaugccacuauacauacacuagaauggcuaaaauuaaauauauugaugauaccaaguuuuggcaaggacauggaacaugugcaauccucauacauucauuacuuguggaaauacaaaaugguacagccacuuuggaaaacggguuagccauuucucauaaaguuaaguauaaauuuaucauaugacccaggaauuccacuccuaaguaucuaucaagagaagugaaaacacguucauacaaagacuugaauauuuuuauucauuaucaccaaaaauaggaaacaacccaaauguccaucaucuggugaguaaacagagugugcuucaucauacaaugagauacuauuuagcaguaaaaugaagugaacuagucuuuuaugcagcaacuucagaugaaucucagaaacaucaugcugaguuaaaaauuguaacauaaauuauuuagcucuucaugguugaaguuuguacuauuuguaauuuuuuucugucacaaauaaucugaugccaacaaugcauuagauauucuuaaagauguaucucuguacauuuuaacaagguuuuuguaagaaaaauuucuagacuauaauugcugggcuagugaacauuuuuauuugcuuauauugccaacauuuauugaaugcuuauuguguaccaagcacuauuaggugcucuuucuacccagauuaccucauuuaauuaucauagcaaccauaugaggugcaggucauuacuauuuuccucauucuauaauugagguaacugaggcacagagagauuuaaaaacuuguuccaaaucacacagcuagaaaguuagguaaaccaggauaguuugauucuagagcuuaacuuccuagcuaagacaugugaaguuaaguuucuaugcaucuuuugagggguguuguauuuauuuucaggucuccuacuugaucucacuguaugcauuacagaaauuucuuguuuauuuauuuguuuauuuugagauagggucucacucuguugcccaggcuggagugcagaggcucgaucucuuagcucauugcaacuuccaccuucugggcugaaaugauccucccaucucagcuccugaguagcugugaauccagaugugcaccagcaugccuggcuaauuuuuguauuauuuguagagaugggguuucaccauguugcccaggcuggucuugaacuccugaccucaagcaaucuacccgccucagcuucccaaagugcugggauuacaggcgugagccaccagacauggccucucaauuuuaaaagguuaggaugagccaaauauuuauuaaaugagucuuucccuuauugaaguaauuucagaaaugcaccauuggaauguuguuuaauuucaacagguacaaacucacacucaaggaaaaacccagccauucacucaaaggaacauuauuuugauaguauucagauaucguauacaaaucuuuugagcagguuaguuuuuucauguaaaucauaacauaugguauuggucaaguaguaaaguucauauuaaccuuaaacauuuacuaagauacuguuuucaaguaacucaggcaauguaugcagagggugucauaguuucuguaaguauauaaguuuuggaucaagaucacauuaaugccagggccccacuacagaucuucugaaucagagauucugaaucugaggugaagacucauagcuccuuaaaauuccauggagaaaauauauauauaccuacuauuuucccacgaaaauaaaaaauuuaaagacaauuuccuggagauucuaauucacauuugggucugagaauucuuguguagggcauacucuccauuguuaaaggauacuaaaaaguuacauccuauaucucagauacccaaaggacauuuauuaagucuuauauacaccucucacaaccuauaagcuugcaaagcaaaaaggccuucuaauaccccaaauugguuuauauuuucuugauaguuuuaacccuauagauuaauauucucuuaccuuuuuccccaaggcuucuaaaaguagaugauacuaucugucuuuaugugauaguugcuuguuuguuaacuucuuuaugacaugugccuucaagugauguucuaaaacuaaacuuuugaaaguuguuauuccccuuguaaaagggucugcccuuuucccucuccuguguuuuucuccuuaaccauuucguagugcccacagguagcgugguauauauuggucaagaauguaggaugcaaagggggguugccuagauuuaaaacccagcucugccauuggcugguuguaugaugcuagcaaguuaucugccuucucauauuuauuucaugggauaguaauaguacuuaugucaugauuauugagagaaguaaaugagcuaauauauguaaagcacuguaccuggcacauagccauuaaaauuaccaccugcuucuacucgccucuccccuguuggcuuuauucuccucuguuggcuuacaugauacuguacugccauggcuuucugugaucucuugaaccauuccuucuuugcugguuuccuuucuucucacuaacuauaaauaguauuucucucugguuuuggugucaacauucuucucuauauguaauaaggauuauaggccugucagguagacugggguuugaauucuaccccugccacauauuagcuguaugaccuuggaauuuuaaauuuccucaauccuuuccaaacuuagauuucuaaucuguaaaauagggguaauuccuuuauagcaggauuguugggaggauuagagauaauauaaagugcccaguauagggucugaaacacuguaguugcugaguaaugggaucugcugcuccugcugucuuuucuagcuuauugaucucauccacuucuguaucuucagauaccgucacugaacuguugaugccuaacucuauuucucuaguuagauuuccuucuugcacuguuaagguguauuucaaacugccauuaaauguuuucuguaugucuuauuggcauuuuagaguuuucacacuuaauaucagacuaauccuacccuauuaucuuccuucugaaaccugcuguuuaucauguguuccauauuuuuacucauguucuugaucuccuuuuaggcaugguaccuuagcauugaauugauucauucauugucuuugagucuguuucugguuccucucugcguucucacaccaaggcucaaauauccaucuuuugcuucaguucucacuacuauaguuaaacccucacuuuaucguguguguauuuuuucccccaguagccgugaaugucaucucccuaccuccauuauucuuuguuuuccccaaucuguucuuuacauucaucuuucucucuuaucagauccaucuucccagaguggauauuaggagauucuuuaccccaaagagucaaauaguagauaguuugggcuuugugagccuugccguccuuguugcaacuguuuaacucugcuguuguaacaggaaagcagccauagaaauacgugaccacguaagugugacuguguuccaauaaaacuuuauuuacaaaaaugggugguggucugggcauggugguaugcaccuauagucccagcuacuugggaggcugaggcagaagaauugcuuuaucccaggaguucaaagccagccuggacaacauaaugugacccccaucucuuuaaaaaaaagaaaaagauguuggacuagacuuggcccacaggccauaguuugcugacccuucccuuccuaccuuucuuucuuucuuuccuuuuaaauuaccauuccuucuaguauuucuugaacuaauuaucuuuuugagauauugacugcaagguagaaugaacuuuuagcucccuauuuuccuacugucaucuaaaauauuucgguuuuaaguguuuugguucucaucauuuggagaaguacaaauuaugcaauuacaaagauuccagaaauaauucucauagcauuugcccugaauaguaguuccugacucuuucuuagaugcuacuaggugcauguguuaucaauacaguccuauauacugugguucuuuggggagguagcuuuaggucugaugggcuuaucaguuucuucagaaccugcuuugaccucuguguaguaguauuccauuucaucugucuuaucucagccuuucagauuucacugacugaugaaggaacauuucuauuuggccccuguauauuucuccuuaggguuuaggugcauucuguaucagcuuuguggacacuuuccuuaugugcccuuggagaucuucuugcaacauucuaauuuauuaaguuaaauauuuuugaauaccuucuguagaacugugcugaagacauaaagacaaaacacaguucuagccuuaacaauccucauguuuugaugcaggggucaggugacucccaaagggccagaucauaaauauuuuaggcugugggcuacauggucucuguugcaacuacucaacucugcuauuguaauuugaaaguagccauagacaguagauugagcuugacuguguuccaguaaaauuuuauuuacaaaaaucagugguaggccauauuuggccugcaggcuauaguuugucaaucccuggucuaguggcauugugccaagggauauuugaagccacagguaaccagugugucuuccuugaacguaauuuuacucaguuauuguggagaaaaaguuaaguaguuugauuuauauugauuuaaaacauucuuuuaauaacauaaguggccacccaaggaauagaauauaaaaucaagaugacuauuuaaaaugaaacagccuugcaagaaaugucuuguuuguagcgaaccucuuagaucuguaacuacaaacucuucugccauuuguuggauaagcuugagaagcacugcuaggcauugggagcuauggaaggauuuagaggagggcagugacaucagauuuuaauuuuagaaaacuaacuugaauggaguguggagaauaguuuggagaagggcauggcaauucuggagggagggagauagauaagaagacuguuaacaggaauugaagcaaaagauaagagcuucuuuuaagauguagguauuggagguagagagaguuauacagauuagagacauagcaagaagguuugauuugauugauuguguagggcaagggaaauggagaaggaugagucaaggaugauaguucuaaguuuccguagggagacugguugaacaaggaugccacucaguaaaggaaauaauacaugaagaagaguaaugugaaggccagggaagacagacaaauaaauugcuuuggaacuguuaaguuugcuuugcuuguggacauccagauggaaauugguuuuauaugacuuaaggcucuggagagcaaccucgacuuacuggggugggcaugagauugaauguaauucuccagaggaaaaguugucuauagcaaggguauuugcucaugacagaagccaaugaggggccgggcucgguggcucacaccuguaaucccagcacuuugggaggcugagggagguggaucucaaggccaaaagaucgagaccauccuggccaacauggugaaaccccgucucuacuaaaaguacaaaaauuagcugggcuugguggcgcgugccuguggucccagcugcuugggaggcugaggcaggagaaucgcuugaaccuaggaggcagagguugcagugagccgagauccugccacugcauuccagccuggcaacagagcgagacuccccaaucucaaaaaagaaaaaaaaaaaaagaagccagugaggaaaaaacaaaaacugccugggucaguagaggaaggggguggggauguguauugaaagaaaaggaagaaaaccagaagacggggguguuuuagagaccaagaaauaauagagguucaagaagaugaauaguaccaaacacuauagagaggguuaauuaggauuggaacuaaaagacauuuauugccuuuuuuuuuuuucuuuuuaaaggagugggguaauuugggacuuuuccugggguaauuucacuggaguugugggagcaaagucagaaagcggugcguugggugugagugguaugugagaaaacguaagcagggaccuuagaccagcacuucuggucuacauuaaugugucuaugagucacugggagaucacuuggagaucuuguuaaaguggagauucugaaucaguaggucuggcauggaugcccagauucuacauuuccaacaaccucccaagcaauggggaugcugccguucugacagccaccugaacucaguaucccaaauuguucaucgauguaucccagagcacuguagcuaacuugcaagggugccauggaauauuuuuaaauuucaagggaaauacacuggcgucauuagauugcuguauuagaucacugcauuccuuucagugaugucauaccuuugggaagcuggauuuucagugcuugcucugauaaaaagcaaguacugccugaaaaucaguguggaacaggaaaugaggcugucaguguucaaucugaguccagaguuugaaaaguaugcagugcccaacaggcauccaguuuuuagaacuuaaaauacuuacuaagugguuuggcucuuacugcuuaacggaggcaacuacaguuguuagauacuucuuuuggccgagguuuacccugcaagaucacugagacacuaaagauucuuugagccaagaaaguuuggaaccguugacauaggacuucuucauagaaacuugucuguggagccaaagagagccuagaugauugggcgguagcuaaaagaggaacaaaggagcauuuauuuuaaaauaaaagagacagauauguuguauguugggggagggagcagcugauaaagaagcaacaaauguugacuuagaguaaaagaucucugaggaggugagaaaggauggaaucuguuuucucuaaauauugcucccaaaccaacacugguuuguuggaagacaugaagaacguuauuccccacuccagaccuccugaaucagaauaugcauuuuaacacuaucccuaggugauuuguaugcauauuaaaauuucagaggcacuauaggaggcaggauuggccuuauauaggagaaagaaugucucuuccuuuuauuuauuccaucacuauauuguguacuuucccgcauccuagccauucugauugagggaaaugagaugacaaggguuauuuauuuagauaaauuuagaaaucugggggugaaaaguugaggaaguuuuugcuuguuugccuuaauuaucucagguaaguacauagaaaauaucuccaucuagugaauaagaaaauugggacuggccaggcgugguggcuuaugcauguaaucccagcacuuggggaggcugaggcagguggauuaugaggucaggaaaucgagaccauccuggcuaacacggugaaaccccgucucuacuaaaaauacaaaaaaaaaaaaaaaaauuagucgggcgugguggcgggcgccuguagucccagcuacucgggaggcugaggcaggagaauggcgugaaccugggagguggagcuugcagugagccgagauugcgccacugcacuccaaccugggcaacagagcgagacuccgucucaaaaaaaaaaaaaaggaaaauugggacuaaaauaauggcugagagaggugagcaauggagauuugaaauaaccauuuugaggaacaucaacaaaccugaccagaaauacagaaauugccaaggaguucugaagguccaggugaggucagagacaacuuuuaguggugucaaucugcauaauuauaacuuuuuccaguggugcuaguagcuugggugugggaacugcaauaaauuggauuagucuacguuuguugauuugcagcuugagguuaaugaaaaaauaagcuagcaaaaaucuauccugaauaugaaaagaaaugaagccacaaggaggaugagaugagaaaaaggaguagaaggauuggaguucuccuugcaagccaaugaaaaggcuacauauccugaaguuggaagaauccugcccuuguuuuuauccacagggagaggaaaauucuuuccugucaggcugcagauauuuaacagggcuuugugacugauuagauaacaggaaagaaguuucagucuaggaugacuccuacuguucugauauuaaaaccuacugggaacauaguuaauaauugaugauaaauuggccuccagugagcauuuuuuuuucugaaagggaaaggcagagggugugaugaggaagcauggaggcaggaugagauuuggaaauguugaauuugagguuggauaggagaguauguagguaaagauggcuguuuauaccacuggaaacagggacauggaauauaagaggucagauacaaagaucagcuugggauucagugauauaauaauagccucuauugauuguucauuguuaugaagaagacugagcaguuuauauugucauuuauccucucaucaacccuuugaggcagguauuaagccauuuuacagaugaagaaguaggauuagacacaugcccagggccacgcagcuaguaauuguuagaaacaagauuaggaacuagaucucuccgauuccaaauccaugcccuucuaagcucuacuauauuuuaggucaccagcuucuggcucuugauugauaccugacguguuauagagcuucucagaugcaaauaaccgaaacaaaacaaaaaucuuucaaaugagcuuaagcaaaccagaacaaaauguauugguccuuaccuaugggucugcugauugacuggcagaguuggaaccaagggcucaaacaauauuaucaaaacuugaucucucagcuuuucuuuucuauauuaguuauucucuuguaagcucccugauaugacaacaagauggcccuaauaguuucagcauuacaucauggagauacauacagaaagagagcugcucuuuaccaagggcuuugacaaaaauccuggaguugccucugauuggcuuaggcccuuugcccauuucugaaccaacuucuggccaggcuugagccacauguccacccuggaggguagagagugaaccucaccuaggggugagaacugaggacuacaggucaggcuuucccaaguaaaugaggcaccuggaaagagaagaaggggaauggaugccaggcaaacaaaagcugcuuguccacacguggacagggaugaaaaaucucaccugugacugcuugaggaugaagauaaagauuaugagacugucaguaaugaugaaaauaagugacauuuguuagaugcuuacuagguaccaggugcuaugcuagucuuuuacauguauucuauuguuuauccucaccauagguuuuugaaguguauacugucauuauuuccaaauacagcuaggaagugguagagcugagauuugaauucaggcuggacagcuccauaccucacccucucuauuaccaccauaacauuuuacuuguaauuuucucauuguaguuuucacauuuugucuaguuacacugguugacagcauauagugaaucagacagaccugggccaccaauuuuucuacauaguaugcuuaauaaauaauuguuaauaugacuuaaauagcauuuacuuuaaguauuauaguggaaaauuuuuaaaauuaaguucuuaguuuuucucuuaaaauguuuugugcuuuauuuauuuuuauuuuauuuuauuuuauuuuuugagacagagucucgcucugucgcccaggcuggagugcaguggcgcgaucucggcuaacugcaagcuccaccucccagguucacgccauucuccugccucagccucccaaguagcugggacuacaggcgcccaccaccacauccggcuaauuuuuuguauuuuuaguagagacggaguuucaccauguuagccaggauggucuugaucuccugaccucgugauccgcccgccuaggccucccaaagcgcugggauuacaggcgugagccaccgcgcccagccugugcuuuauauuuuaaucuuauaaguggcuuuuuauguuuagccacucugguccuagaacucuuuuguuuuuuuaaacuucuuauaccauacuugaauauguaaaauucuaguuggauuauuucauuuuuaguauaucuguagagauuauggaaauauuuuuguuaaucuuuguuuagucuuuguaauaauaguuucaaaaucuuaucuaguauuucuauaaacgcuuuuuuauaaaaagcuaauaguguguuuuuaaggcuuguauuuucaaaauaauuuauucugagguuguccuguuuacuuauucaaauugguuauucacaaaaauaaaaagauagucucaugugcucuuauuuuuaagaugcguauuuuaagcauuaaaaccauauguuuuguaacagaguuugaguuuuuagacuaauaaaaguuaccgaguaccauuuuauuuugguuuucaugauuuggggcucugcggugccaauuauauuuuuuuaauccugucugaaaugucugaucugugucgucauaaaggaagcagugcaggauuggaaaucaggagaccccuuuuuguccuuugggauuccccucucuaaagaguuugggccagaccuuuaugaucuuuuccacuuuuaaaauucuaguguuuuuauuuuaaaucucugcuagaucagaagcacugccuuauggauguauagucuuagagcuagauuggaagauagcauaguccagguuccuuauuuuaaagauauaccagcugggcaugguggcucacaccuguaaucccaggacuuggggaggccaagaugggaggaucacuugagcccaugaguuugagaccagccugggcaacagaaugaguucccugucucacacacacacacacacacacacacacacacacacacacacaaaaaaaaaacagaaugaguucccugucucacacacacacgcgucggucguggugaaucaguuccugucuacacgcacacuagccgggcaugguggcuugcgucuguagucccagcuacucaggagacuggggcaggaguauugcuugagcucaggaguuugacguugcggugagcuaugaucacgccacugaucuccagccugggggacagagaccuugucucuuaaaaaaaaaaaaaauuaauaauaguaaagauaauccaggcccaaaugauagcgucuaagaucucaccaucauuuagaaguaguggagcaaggacaggcauuucugccugugcugccuuaugcucuucuuuccucaaaacgguauuagcaacuugaagacagacaacauucauuuauuugauuaaaggaacauuuauugaaucgcuucaaucuaucaggcauuuuacuaggcaugugguuagcugcaaagauguguacaugagggaaugugcauauauggaggcccaaaacuggaauauagaguccaacaaccuuggguucacagucuaucugaccacuuaggagcaugaccucaguuaaguuagccauucuaagccgcauuucuuugucuacaaaaugagaauaauaguaguagacauuuacacaguuguggugaggauugagacuauaaagauuaaacuuagcauaguacguggcacauaguagacucucuuagaguuuaugaaagaaggaaggaauuaagacuuauggaacauuuuccuguauugucuuauuugauucauaccccugugagguagauagugauacccuaauuuuucaagugaggaaacagcgcugaaggcuugggacuuccccaagguccacagccauuagucauaccuaccauacacauuauuuuuaaaaagugcaccagacacuguuuuaagcauuuuuauguacuaguuuauuagcuuugcaugugguauacuauuguuauuuucacuuaacagacaaggguaguuagguacagagaaguugaauaauuugcccaaaguaacacagucaguaaguggcagagucgugugcuucaugugcaggaaaucuggcuucagagucccacuguucuuuuguuguuguuguuguuuguuuguuuguuuguuuucagagagcaucuugcuguauugccaggcuggaguacaguggcgcuaucucaguucacugcaaccucugccucccggguucaagugauccuccugccucagccucccaaguagcuggggcuacaggcgcuugccaccacacccagcugauuuuuuguauuuguaguagagaugggguuucaccauguugggcaggauggucucaaucucuugaccucgugacccgccugccucggccccccaaagugcugggauuacaggcgugagccaccgcacccggucagagccccacuguucuuaaucuuuguguucuuccuuuuacuucaugcucucuuuugugaaggugaaaagcaguuuuacaaacuagaaggugcuacauaagaugugguauauuuaucugacuuggucccuguacuccagagauuacaguccaugaggaaugugucuucuccaggcuaaaccuacucauuuauugccacuguuacucgcuggauauugcugucacuauuuuggccacuuuucuuuaaaaaaaaauuuuuuuucauuuugucaacguucgcccucuaauguguccccagaaauggauacaagcuucaaagaucucuauucugccaagcugucuuacccucauuuuauaguuuacucugcaagaugagaauaaaaccugccuuccagggauuguaaagauuaagugaaagaauaaauguaaaguuauuaacacauaguaauuugucaguaaaugcugcugguuauuacuucuguauaguaugguugauuuuugccauuuugaaaguaggauuuauuuuuaacuuuauuagaauucaucauguugauucaauugagaucacauugaaucuucuuucuuuuauuugugauauuggcuacuuuucccagcuuuguaugagcuguauauuuuccuauugagaaagguuacauuaauaagauuccuuuauuugugugacucaaaaucauugauaaaaauauagacuagcuaggcugggcgcgguggcucacgccuguaauccuagcauuuugggaggcugaggugggcagaucgccugagguugggaguuugagaccagucuggccaacauggugaaauccugucucuauuaaaaauauaaaaauuagcugggcgugguggugggcgccuguagucccagcugcuugggaggcugaggcaggagaaucgcuugaacucaggaggcggagguugaagugagcugagaucacgccauugcacuucagccugggcgacagagagagacgccgucucaaaacaacaacaacaacaacaaaaaaccaaaaaauuagguaggcaugguggugcaugccuguaaucccagcuacuugggaggcugcggcaggggaauuguuugaaccagggagguagagguugcaguagccaagaucacgccacugcccuccagccugggcgacagagugagacugagacagacagagagcgagacagagacagacacuagcuacaggcuagagauaguagaaccuccuggcaggcuggcagagaggccuggauguaggauucauagagaaacuaacuauuaauguuaguuugcccagcucacauuucaccgucuuaucaaccacauaugugagaauauuuuucaagauuuuaaaaaauguaucuaguugguucuucccucuuaauuuucuuacaguucucucaauuuaauuacaaaugugaggccuccauccucuguccuuagacuucuugcaacauucucuuuaaauuagucauauccuuuagcagugguacucaauuuuuguuuuauggcccaucaaucacuuugcuuagagucacuggguucuaacacccucuacaaccaaaauaaacuuccucuuuugucaacaagacauuuagauguaauaguguauagcaaucuguaaagaucugccuacaguagauuuacauacaaugauauugaucagaugagcaggguagaucacuuaacagguucagcaaacauugugacauaaagauuaagccugggccaccagaaaacuguggaucaaagaaacaggugacugaagaauaggugagaggcagaagagugguauagauggauguucugguggguggugggaacaagcauuugagagagagauuggauauugguaguuacugacaguaugccugacagauauugaugggauguaaggauauagagaacuugacuucuuaauaguuguuaugaaaaucuuguacucagucuguuuuucuaaaccacucacuagguauacuuaaacauccuuaaaaauaaguugcggccgggugugguggcucacgccuauaaucccagcacuuugggaggccgaggcgggcagaucaugaggucaggagaucgagaccauccuggcuaacacggcgaaaccccgucucuacuaaaaauacaaaaaauuagccggacgugguggcaggcaccuguagucccagcuacucgggaggcugaggcaggagaauggcaugaacccgggagguggagcuugcagugagccgagaucaagccacugcacuccagccugggcgacagagcgagacgccgucacaaaaaaaaaaaaaaaaauuaaaaaaauagguugcaucuagggccaaaauaaaaacacaugguacugaaugaaaaccaucuguaggcauaauuuaguauucugucuuuauuuaauuagggggguguguguguguguguguguauacauauauagcaugccgguguuauuuugacaucucaugcaaauggcaaguugucaaacuucaauuuuuuuuuuuuugacuagccacaggggcucacaccuguagucucagugcuuugggaggcugaggcaggaggauugcgugaggccaggaguuugagaccacccugggcaacauagcgagaccucaucuguacaaaacauuuuaaaaaauuagcugggugugauggugcacaccuguagagcuguucaggaggcugaggcaggaggauuacucccacucaggaguuugagguuguagugagcuaugauccaagccacugcgcccuagccuaagugacagaaugagaccuugugucuaaaauauauguauauauauuuuuacaagcuagcaguacuucuaucaaucuuuagcaauggaugguaaaacccaccuucuguuuuaaaauuguauuaaagauguuuauguuacucuucuuuaucugucuaaucuaucaucucuguucucucaagguaaaucauuaauugauuuauucaguagauauuugagugccuguguuuggcacuaggaguacaagaauaaauaagagcugguucauccucuguuggagucuacagucugguuggggaaacccagaaaaaaaaaugaguguguuuagguguggcaauauauaaauaauuaaguaacuuuucuaagaaugaugugaaaaaacaaauaacauuaaacuaauucaaagugauaaaaguagaaugagguuaauguuagaugaaacagacucaucauuauuuucuaagacuggaucuuguccuuacauuaaccacacucucccgcagugguauggaugcaaagauuaaacacuucagcucuuaaaacaagacuagauaaaauuauuuguaaaauggagauagucauuucucugaauaccucauggaguuguugcagaauugaaaugagauaauuauuuguaaaugcugugaacuagaguucuauacaaauagaacuuguacucugaugaaaguugugacuugaaucuuuguccaucaugccacaaaaaaacuuuucagaaguguuugguuaucugccuacaaagggaguuacgcuauuauugaaaaaaaaaaccagccgggcauggugguucgugccuguaauuccagcacuuugggaggccaaggcaggcagaucacuugaguccagaaguccgaggccagcugggcaacauaguaaguaagacccugucucuauaaaaaauuuaaaaauuagcuagucuacucaggaggcugaggcaggagcccaggaggcugaggcugcauugagccaugaucacgccacugcacuccagcaacagagcaagaccgugucucaggaaaacaaaaauagaaaaagaaaaaaaucagcuccuuuuuauugcaguuacugaauucuuaagagccugauuuacauguuuucuggccagucuuagcaacuuacugcuuuauagcuguacuacaaaaauggugccacucagucaccuaccgaagugaaugaaaaccucuagucugaaugugucacuucuuuguuuaaaccucuucaguggcucccuguuacccacuaaaacccaaguucaucauuggggcuuacuaagcuuuugggaaggggccagagcuauguccagccuuaccugucacauuccuugacucacacgucagguucacccuuguuugcaguuuacacagcaugugucuacacacacaccaugaccuuuucucuuccuggaauaugcccccucuccuuccuuaccuggcuaauucauacucuuucaaaacucauuuuucagauaguccuuccugaucccaaccuucuccccagugaaguagucagcgcauggacuggucauuuuaauugucaucuguguuggaaugaucaguuuuccucucuguucuacucacacuuccuagcacuaugccuuacacauacccuaacugaacauguucaaaacugaacuccugaucucucccauuguccagacucaggcugcaccauaugcugucuucaucuguuuaugguaauuacauuuucccuauugcuuaaaccaaaaccuuagagucaucuucuuuuauaucucauaccagucuuucuggacaucuugcuuuauucugccuuuaagauaguaugaguaucccagcacuucuuaccaccuccauugcuaccacugugguccaagugaucguuguaccacaccugauuuaugcgguagccuucuaacuacucuucugccuuccacucuugccagccuucagucuauuuugcacaucaggacuuggcagacuuuuuaugucaagggccagaugguaaaaaauuuagguuuuguggccugcacggucucugucauagcugcuagaccggaguuggggcacaaaagcagccauagagaauauguaauugaaugaaugugguugcauuccaauacagcuuuacuuauaaaaacaggcagugggcuguggucugccagccccugcucuacauggcaaccagacuacccagugccuuccggugacuuaaucuuuauaguguucucuaaaacccuccaugaugugcguccccaaccccuuaccugucugacuucaucuuacgcuguugucugcuuuccucccuccucuccagucacacugacccucuuuuuccucagauaugccaggcccauugccaccugauucuuugcaccauuuauuccuucugccuggaacauucauuucuucuuaaaugucaacuucucagucaggccuaccugaccaaccacccuauaaauaauuacauucuagcauuauauucccuauugcguguuuuuuuuuuucuucguaaugcuugucuucugccauuucuuauauuaugcuauauauugacuuaauuuuuucucuuucuuuuccugcuagaauaaauguucccugaaggcaguaacuuuguaucuuuucuauuaaguaguguauccccaagaucuagaacagugccugacguauaguaggugcucagaaaauauuuguugaaugaacacauaguguauauuuuuaggguuuaauuuuuuuuaaaugaguucuuucucucucgccagcaccauauccuuucuguuucacacucuuacuguugcucuaagcugcccuguccuuuccauucucacuccccuuuauucugacucucaucuauuagcaguguguccauaaccuuuuauuucguggcaucugggccauccucuacaaguagauugagugauguuuguaaaauggaaaaaugauuuuauuauucaaaacucuuuauuuuugauuuuuugccaauuacaaugaagugcuuguuuaaaguacaggaucucuuaugaaggaauaauugucaagaaaaaaaaguacgggaucucaggccucaugccauaccugauaagucauaauuucaagcagagggcauaagaaucaucauaauuuaggaaguaacccaagcgauucuuacugaacacaguuggccaacacuggccuguaagguaaaguuccccagugagucagugagagccuuuuugagcugccccugccugucuguccugccccaucccuauugcuccacacugcacuucaucuuccaacaguuuuucuauuugcauuucucucaaggcaccauauugauucuguuuuugcaaauauucuuuucccuguacagaacagaaucuucuacucuggaaaacuucuauuuuugucuuucaaaauucugcacguuugucacuuucucuauaaagucuuuucugauccccauucccgugacaaaguuaauuaugucuuugcugucuggguacuuuguguaaguaagacucuguucugguguuuauuacacuguacugugugccuuugcauaacuguuugccuguugugaccugaccugagccaguaguuguuuacggguauuagguuuuuauugagagguacugcuguucuuuggaggcuacaguuaaaugaguguuacaaaucucuucccccagaaccgagcuucuaaauggcauguuacugugaaagcaaaacucacacugaguucugccacacacaaaaaaaauuuauuaggaagcaagcacaaaaauacuguuuuauuagguggauaaaauuccuacucucuaugcuuuuagaacaucugacaagcaccuuuuuuuuuuuuuuuuuuuuuuuuuuuuugagacagaguuucgcucuguugcccaggcuggaaugcaguggugcgaugucggcucacugcacccuccaccucccagguucaagcgauucuccugccucagccucccgaguagcugggauuacaggcgugugccaccccaccugggugauuuuuguauuuuuaguaaagaugggguuucaccauguuggccaggcuggucucaaacuucugaccucagaugauccaccugccucggccucccaaggugcugggauuaccggcuugagccaccaugcccggccugccaagcaccuuuuauggaagguuuauuuaaggcaaaaaugcuagugugcuuuuaggauucagcugaaccuaauuggaaucaaauaacagaauuccuuuauggggaacuaacagaaccagcaggagucauaaggcucaggguacagucccuaauaguaggccauuagauuaacuagauucauguauauguucauguaagagcaguggucccuauacaguguguagccauaacaccuuucuugaguaccauucuucucuaauacugucauaauuucuaauauccacuauguuaauuacuaaauucucuggcuuugagaugagauaaggcuucuugaguugucucacuggaguaggguuuuugauuacaagcuuuccucauuuacugaugauuauuuauauccagucuugggcuugcauguuaacuaagugcuccaggaugaaugucaggaaccucucacucauguccucuaguccauuaaaacaaauaauaauuacacuguuugugccaaaauaacuuaaggaauuuaaaucguaacucuucuagacccuggaauugaaacagauguuuuacuuuuaaucucuguauccucaugccuagugcaguaccugcucagugagccucaagaagugccagaauguauguuuguaaugucaagcagcuaaguguuuuguucuguuuguauuuuuguuuuuaaugccgaauugcagacucuuccaacgaauuauauuaauaauauagcaaguuugccauagcugucagaauaucugucuuaacagugauacuuccuugcaugggcuagaaugagguuguauaauucccuggguggggaucaagcugagaccugcucaggauccccagucuccuuguggagagagguugcucugucuuccucaugaaguuugcagugggaguggugugugugauauaaauacagagcccugcuugggaaucuaagaaagaguugugcagugcugguaagauuauagcugagguuaacaaauuguagaucucuguucugacagcagagcuagacagcucaaaauauaauguguuucaccagaugaauuucuuauuuguaaagcauaacuuuaucaauucuucacuaaaagggaaaugaaagcucagagaguacuaaggcaucaugacauaucucuagauuauacugucgggagcaucauacuuaaguugauuuuuaaguguauauuuaaguuuuuuuaaucaugggcuagaauuagagccuaauaaggaaaguaguuugguguuagauuauuaaacaauucauaauucuugggccacuuggagagugauuuggaucaaugcuauuucuucuucaauaaucuuucauuguuuuucuguauuuuucauauuucuaugaacaugggaagaaucuuggauuuuuaaaaacuuuacauugauaauuaauauaauuauauucugccuuccuguaccgauaauaaaaacuuuguauuaacauacucuuccacacaagcagaguaaaaagguugaaauuguuguugugucauaugacagcgguuaacaaccaaagagcucuuaaaaaucaguagggggccaggugugguggcucacaccuguaaucccaguacuuugugaggccagagugggaggaucacuugagaccagaaguucaagaccagccugaacaacguagugagagcccaucucuagaaaacauuaaaaaauuagccaggugugguagcguguaccuguacucccagcuacuugggaggauugcuugaucccagauguucaaaguugcagugaaccaugaucacgccacugcacuccagccugggugacagagugagacccugucucuaaaauaauaauaauaacucaguagggaaaagauuaacccaguagaaaaguggauaaaggauaugagcaagcaguugaagaauuaaauggccaauaaaauaugaaaaaugcugacuuaaaaauauaagauguaauuaaaacauuaguaagauaaauguuaccuaucaaauugagcuguuuucaaagauuaaaacuuacuaugcuggguuggcaaaugguuaaaaagaugugugcacucauacaaagccaguaggaauauaagcucaugcaauaauucuggagaacauuucagcaaucagaaagcuuuaagaccuaauaauuucacuuauaguaauuuaauuuuaggaaaauaucaaggauuuacaaagauuaagcuccaaaacuauuguugaucacaauauuauuauaauagcauuuuucuaauuuuuaaggaaacuauaugcccuuauaugucuuuuuaaaauauauauauaccuaucauuuacacuuagaaaugaauuagucaaaaaauuagucagaaaucauuuauaauaagucagcuuuugaccacugaguuguuuacugugaucaagaaagcagcaaggcuuaaggaguucuuauucuuuuuuuuuuuuuuuuuuuugagacggagucucgcucugucgcccaggcuugagugcaguggcgcgaucuccgcucacugcaagcuccgccucccggguucacgccauucaaggaguucuuauucuaaaugacuuuauuucaugacaaucuguucucuguucucuucucucuguacucccuuggcaaucuguggcaggcacacggcuucagcuaucccaugcgaagauggcuccuaaauuuacauuuccagucaugacuuuuuuuuggaguuccacacaaguuuccaacugcccuuugaacauccccaccuggauggccuuccagcaugaccuguuuucuuccguauuugaacuagauuuuuguagacccccaagguagugauagugauguguaugugugcuuuggaagugggcagggaagagacuuaaaaagauuuaacuguagaacugaaaaauaccaugugcaguacagcagguucuugaauaacauuauucuguucagugucguuuuguuauaauguugaugagggauaaagaaucaauuccuggccgaggccaaugucuguguggagcaugcaaguucuccccaugucugcgaaguuuucuucaggugcuccaguuuccucccacaucccaaugugugcaucuuugggauguggacugacguaucuguuaucuuagugugagugaauaugggugugugugagugcaccuugcaguagaauggcguccugcccaaggcuggcucccaucucgugcuuugagcucccaggauaggccccagccaccugcaacccuaaaacuggacuaauggcauaaauaauuaccuuguuuuuauuaaucuuucuuaaauguguauauagcucacauuuauuucaagguuuaccauuagaaguguuuuggucuuuauuuagaaguuuggcaauguuuuaugaccacaaauaugcuguagaaacuuaaguugguuucauuauacauuguuucacauaaaguuuccaagaaccuaucgaggcuauuagugaggacuuacuguacaucuugacaugggagaauugggcauuaggcaugagcaugugccacugcagcagguggugggccgcuuacgagucuggauuaccaauuucaucugaacucuuggguggacuauauacaugccuuacuggagcaaggaauugaagaagaauacagaaggaaguuguuuuucucugccucaguucauauccugccucugccauuuagagucucugaccuucggcaauuuuuuucuuuucacuccaguuuaguuuucuggucucuaaaauggggggagaaauugugccuaccuaagguuugcuguaaagaaugaccgagguaauccaugccuggccuauaagugauuaguaaauguuagcugucagccucuacaaaaggcauagugcuaugucaaagcauagugcuuugauaauauaguuuaauaggauaaauuuucagauaguaaaccuuuucccuucauucaggguaaaaauaauaguucuguaacccaucaaaguuuaguucucuaagcuuuguaucccuguuuuaaaauaauucagcucaaaaaagaaaaauaaguuuccugguucagcuucauauugaagccuucuaaugcuagaaauaaaugucucuagauuccucagaggcauugcggaccucuuccuuccuuuuauucucagagugaaaaacaaauuuaugcuguuuccuaucuuaagaacauucucaaucagccaggcacggugucucacgccuguaguccuagcacuuugggaggccgaggcaggcagauugcuugagcccaggaggggaagaccagcgugggcaacgucgugagaccuugucucugaaaacguaaaaaagaacauccuuaaucauauauauuuucauaucagaaaagaaaaaaauaguauuguuuuguuuuguuuauguauaaauagguuuuucucgaugggaaauugaaacauuuaaaguuggugucucuauaagguggcaaauuaggaauuuaccucagaauuauauagugguggauugcauuguuucuuuuucaggcuuucugguuuauaggguuauguugguauuuuucguguuauucuuuuuacaauuauaaucaugaacugcugccuuuccuggggcugguauuggcaaguuaauuggguuggcagauccaugcaggcccuguggagcacucauccccucucccuucuuccuuucuccucauuuuucaguauuccugucaccagagcagagcacaagggaccuagggaaugccagauaagacuaaagugguaauggccacuuuuaaauaauacauuuagauggugauaauugagcuauacugggaauuauagaacuuaacacaauuacauuaaauuuauuaaaacuuuucuucaaaacgugagauuuaaaacuuuucuuuacucugccuuuuauuuuuucaaagaauccucacuuggaauucaaauacuguauaggaaacagcuaagcacugccucuaguuuaagguugggguuaaaaccugcuuguuuggccucuucucauaucacuucauucccaauuaguccccuaccccuagauaccucccuagggcuccagggcucuaaggaaagaguuuagaagugaauaauacaaacagauccccgguugggggauaauccuggugcccucaguuuuguucuauucugggaugucuggcucauuuugacaguuaucgauaaacuccucuccuacccgaugcuuguaauuaaaacugcucuuucaccuaguguuuccauuuucauguacagugacuccauucauuuacuuaccuaggcugaaaaccccguagucauucuugacucuucuuacucuccacucauuagcaaaucauguugguuuucugccuucagaauacaccccacuuugcuacucugggcucagccucuuugguuucuugcccggaaacuuuaauagcuaacuuagucuucucuuuucacucuuugcuuccugcagucuaguacagugguuaauuccauggguucuggaaccagauucccugucaugugacuuugcgaauacuaauuagccuuucuaaaccucaguuuagaggaaugaggaugagaacagugauacuguuuaccucacaugguugugucagacaacuuguuaugcacaaauuacuuagauaggacauggcaaacaguaaaugucccauaaauguuaggugguaagagauauugagguuguugugguuguuuuuauucauacagacuugaaacugauauucucaaaacauuagucagauacauucucuguuggcuuccuggcccuucuuagcacaauauccaaaggccuuccuguggcuuaccaagcccugcagcucuagguuaccugguuccucucugaucacauuggcccgugcucgcuguguuccagccacacuggccugcugcucuuuccugccuuguucagccuuugagcacucauuuucccucugccacauugcucucucuucagagauuugcccaacuugccgcucccuucauuuaagucuaaacccaaaugucaaccacuguucaagaauaucaugucaucuuucucuauauaccuaauuuuuuucauaucuuaagaaaauacaacuuuucacuaccuaacauuacauuauauaucuguuuauuggcuaauuaugcuguuagaccagauuucauaguacaauaguccccucuuaucugagggcaauaccuuccgagaccaaguggaugccugaaacuguggauaguaccaaauccuaauauacuauauuuuuuccuguacauacauaccuauaauaaagcuuaauuuauaaaguaagagauuaacaacaacaguaaaauaggacaauuauaacaguaugccagcaucgcuacucuugcacuuuggagcuguuauuaaauaaaauaagguuuccuugaacacaaguaccacgacgauugcucugaugaccuagaaggcuacuaaaugacuaauggguggauagcaucuacaguguggauaugcuggacaaagggaugauucaucccaggcaaaacggggcaggacugcaagguauuucagugcacuacucagaauggugugcaauuuauaaacuguuuauuucuggaauuuucuauuaaauuuuuuggacuaaguugaccaaagguaacugaaaucacagaaagcaaaacuucuuauaaggagggacuauguaaaugagugcaagggaccuuuucucuuugguucaucguuuuagccccagugccuuucauauacauagucgauguucaagagguauuuguuaaauggauauaugggaugugauggggugagugacugacaaauauuuuccccuuccuucuuuacacaagagaugcugaaguuaccagauaguuggaaaggcccaaauuaacuuuuuugagauguagaguucagguuucccccuucuuucccaugaauaacaauauauuguguaauucaucauaauuacuucaguuaaccacaaauggaguaauugcauuguuaaauuaguacccucuuacaguuacuauucaagguaaacuucuuuccuggguagcuagugacaagaaaaucauuugggcucaucauuuauugagcacuuaaacccacuaagcccaugccacacuccugguuguuaccaaccuccagugcugaaagaaggaacuuguuaagucugucuggaaucaggaaaaacagagacauauauaauguucuccaaaaauucugcugcuuauaaagagcagugaauucagagugucuagggaaacaggauuuuuaaauaaggauuuagguuuaagaugccucuuaguuucuuagggaugggaagugaguuuuaaaaauuagcauuuuucuuuuaauaugauaguagaacaauucgguuacuguuugauaacuuuauacuaauucauugacuuuauuauaugaagaaauaaaggacuucaagaauagcucauaacaaaccggguggcgugguggcucaagccuguaauuccagcacuuugggaggcugaggcaggaggaucacuugaggucaggaguuuaagaccagcuuggccaacauggugaaacccuguaucuacuaaaaauacaaaaauuagccgggccuggcagcaugcaccuguaaucccagcuacucgggaggccgaggcaggagaaucgcuugaaccuggaagguggaggcagugagcugagaucgugccacugcacucuagccuggucaacagagcaagacucuguaaaaaaacaaacaaaaacaagaauagcucauaaccuugaacgucuuuguuuguuuucuucauaauuccugagaauuuuuuaaaaaauaccauuaccaauuucaguuaauuaucauguacaccuagaauauggaaguuauuuugugcuuuuuauuuugggccucuuuucuaccuuuaagcuuaacauccaacagucuucugaaccauaucuuguuauaaucugagcaaauaauuuucuuucugauugaaagaggguaaacauaagcuaauuuguuuaguccuuuuuuuaaaaaaaaaucacugacacuaaaugaguuaauguuuggaguuuaguugaccuccuaaauuaucccuauuacaacauaguaagacaccauaucuacaaaaaauacaaaaauuaaccagccuggugacacgugcuuauaguccuagcuacuuaggaggcugaggugggagaaucaccugagcccaggagguugaggccgcagugagccaugauugcaucacugcacucgaaccugagcaacagagccagacccugucucaaaaaaaaaaaaaauugguaccauucagagacagugucagaugggguguugacuggguugguucaccuaucagaugguaaaguagguguucugaggugagcucaaggaagauugaaaucucccauggagcaggacaaaaacguacuugaucuugauuaucuguauuuauaaagauugucaaaguaggaccaagaaauuuuucugaucuuuggaguuaucacugugaagcagaauucaccaguccuuguucaucaaccuaucuuguguucccuauaaauguuaauguagaauagccuuaucuuaucuacaaaauauuauuuuuauuagaagaaucuaaguguaaaucaguagccaaaaaucagagaucugauuuauuagcuguucucucuuuuuauuuauacauggacuuuaauaaucauuauuaucauuauuacaggccaugguugcuuguuauccgggcaauggaacggguuauguacgucauguugauaauccaaauggagauggaagaugugugacauguauauauuaucuuaauaaagacugggaugccaagguaugcaacuuaauugagcauuuauuuuuuucuuacaggugucuuuuucucaaaagcauuaaguuucauacuucugauaagacugucacagacacaguuaaaaauuuuccucuuaaauuuguuucagucucagguauuaggaguggauuuuuguaaaaugaaacaaauacuacucuauguuauacaacaugauaccuguaguuaacaacguaguguugugcacuuaaaaauuuaagaggguagacuccauguucaguguucuaaacacacacacauacacacacacacacacacacacacacgcacacacgagguuaggggaagggaaacggaacuuugagaggugauggauauguuuauuaccuugguuguggugugucaugagggugugcguauauauccaaacucaucaaauuguaaauguuaaagauaugcauuuuuguauaucaguuauaccucaaaaccauauaaaaaaguacugauauaucuuaaaaaguggauucauuuauuuucagauguuagagcacuuaucuaaaaucuaacuuuuuuagaaaggugaccuuuauuaaaauauuuuccuuuuaauaguuuuuagaaaaacauuucugagaacaguuguuuuauaauggcuuuugggggagauuaucuauggauaauuguuaaggauuauuugcuauguuauucuuggcauuuuuguaaaaauauuauauggcauugaguuguuuaauugaauauuggaggcaggauucagucuuucccugauuauuaaaaaacuggaaguuuaucaguacugacaagcccuguaaaaccaauuagaauguacaauauauuuaaucucucuuguuuuaaauauauauuuccuuaauauuagccugagucucauuaaauuuaaaugauuuuuaaaaaauaugucauauauuacuacacuagagacuguacagacuaauuuuuugguugauuuuuuaaaaucuuaaguauaacauucaaauagaaaaguggcuuguauaguucaguggauuuucacaaagugaacauaccuguguagccagggugccuuuuuuuguuguuuuuaagucaaauaaccuuuaaaaaaccucuuucucugcaucccccaaaacacacaaauggaaacugccugagucuuaaaugugcaaaaaccuaauccugcccuaaaaaguguuuuaaguuuagaauaugcucacagugcuucacuaaucuuucuaaaacacacugauuuaaagaguuuucucugcccuaguccagguucaaaauggagcugaccuuucugcugaguauauauugaggcaugucaacaagcaugguuuuucuguuacagcuuucaaaguuugaaguagagaaauaaauuuuguaauugaauuugagcccaaggcacaaaacagauggguguaacuuuaguuaaaauuuaaaaauugacuuuuuuucagauuuugugaauagcuagaaagcuagaacuguguuucaucagcuucuaacuucuagauuuuguuaggcuuuuucuaggcugaucuuauaauuucuauaauacuuagucagggucauuaauguguagguuuuaaauuaggacauaggcagagaaacgucccuaguguuuuuguguguagaauagaaauuuuccaugcuagauugcacugaauauguagugugucaguuguucuggaugcuagggauguagcagaaacggaauuagcccuggcagagcuuaggaucuauuggaggauacagaucagaaagauugacaguuacagauaguuaugcaaagugucaagacagauugcuauggagcacacaggagggccaccuaauucagaggaggaagaguggaagugucaaguagccauuucacuuaaaacauuuucagcaggucaccugugguacucccaaugacuugagucaaagggaagggagcaggaaaaaaggaaagaagacauguucucaguuuggagguucuuuagauguuugcauaguagccuggggaaucacucugaacaacacuggaaccugaggaagguuggcaaggguaucaaaguagcuagaauuuaacuuaccugacagugagccugauaaaccuuuucuuuaacuauagauucuagguuuaggcucaaacgccauguuguccugaccagguguuagaguuucuuuaaauuuuaagagucuaccugcuuaggaguguaguuauucaagaguaaggagcuacuugguugguuggguuuugccuauccccagaucguaaaccccgcaaggacaaagucugucugcauuauucccuacucugcacccagagcccaccacaguucccagugcgauuugaugccuaguugguguuuagguaaauaauaauccuuuauggguagaaucaaguuucacaagcagguagucaucugugcaucaggcccagucuggaaagggagagccacagguucuaaugaacuauaugcugauggugauggugacgacgacaauaaugauggucauaauaaaugaugacacuuucuacugauauacugaauuauuuaaguaagagguauuugugacuauccuauuguuuauugaauuuuaaaguaugguaaacuauuugacauaauuuauuucuaauaauaauuuugucaaaauuucuugaaaucuaucuauuugaaggguggguuaagcaaaucauuaacauacaaaaauaaacguuuaguaguuuuaaaagcuuucaagcaucauuuuaagacuuuuaaauucagauaacauucuuguguuucaucagauauuuauaaaaaucccuaaaauggcuggggacaguggcucacaccuguaauaccagcacuuugggaggccgaggugggcagaucaccugaggucaggaguucgaguccagccuggccaacauggugaaaacccaucucuacuaaaaaugcaaaaauuagcuggacaugguggcgcaugccuguaaucccagcuacucgcgaugcugagacaggagaauugcuugaaccuaggaggcggagguugcagugagcugagauugugccacugcacuccagccugggugacagcgagacuccaucucaauaaauaaauaaauaucccuaaaauaagaacuaaauuuguccuugcaucagugcauauacuuuuaaaauugcagcucaucuucauacuuuauugagacguauuugugaauaauccaauuaagacauugaaauugucucuuuuuuucccccuaaauuuaaucuuguagcauuuuugguuacuccugcuuacauauuuggcucuuuuccuagguaaguggagguauacuucgaauuuuuccagaaggcaaagcccaguuugcugacauugaacccaaauuugauagacugcuguuuuucuggucugaccgucgcaacccucaugaaguacaaccagcauaugcuacaagguaguauuccuuuucagaaaaaauugguuuagaguaugguaggacaggagggaaucuguagaguaaacgugaaagcuuucuaaugaguauuuuccugccagguacuuuucacagucauuuuaauuugaauaauuguauaagauuuauguugcacagucaucugaauucaaauaauuauauaagacucauuaacaguuaguacuaaaugugucuuucuuugcacagccacucugaagaaagggaagcacaggccuucccaucuuucuagcacucucuccgugcuuugugcaucucuuaacuacuauccaugcuuugauuuuuguaagaguauuuuacuugggagagagaaagaucaagaaggaaaaggguuuuuuaaaagguggugagggacaacauaggaaaauggauacagaguagaaaaaucagagguaaccagagaguagaagugaagagaaaaacagaagaaagaaaaguagagaacagguuaccaugugugggaguuaauguuagaaaaaugauccuauuagcuuuacaaauaaugagcaucuguuucauuauacuuuuucuacaagguauuugcaaccuauuauauuuagugcuuuauuucaaaugcuuuuuuaaaaaccauuuauccugacucaauuaaaaugcucuggcugugaaaacaagauauuguagacauuaucaugaaaguaaauauuuguagaaaaauagcacauuaaaaaaaaauacuuauuuuuuauuauggaaaggucuuggaacauucugauagugagcuuccggcauucauuugcuguaucuggcuuaggagaugcuaggguggcaagaagaggcacaggcuuagaugcgcuggguggagaguuggcuuuaguaaugaugguugacucuaacgacuugauuaucagcugugccuuuuuucuuccugccuucugagguguguugccugcauccuaauucacguacugaguagcaagcuaagcagguuguagcuggagauuguaagaaauccugaauggaaaccaaagaaagacugucacaucacaugaugugcccuuuucaaucccaugucucuucccaguggcaucccagugcugucucugcccccugcugcuucuguaaagauuuucugacacaguaacugccucauagaccuuccuuuuuaugaaauccugaguuugguuugguuacguccuuuuuagaugaauaaauaacagauacuugggaguuuauaguaaauaaaugccagauggcauggaggcuaagugcuacaggaguugaggaacgaagguggugcuacauuggagagacgggcaagugcgcuuugaagggagaggcucagcuggccuaggugaggagaggcaaggggugcagucguguuaguaaaguucugggggaaaaggcguaguuguucaaguuaaggcauggaaaaucaugcgacgaaaaggauucuugaaguagaauccuauucugaucuuaucuagaaugggugauaaggcuggaaaguuagaaugacauaagguaaguuguugauccagauauuagaauucugauugcuaagugacuaaaaguuuagggcaugggcaaaagauacauaaaauuauguaucugagcccuuuccuauuuccaaggccacccaaaaguagaagaagccacaugguaagaaagguaguggaacucuggaaagagcagagucuggucuggaagucaggagaccuccuuagaccucagcucugugauucaccagugguggggucuguaaacgucaggcucccaguuguccaaacucccagacucuuuacuucaaaauacauuaugugauuuuucauucugucauauuacuggcuguaugucugauaaauguugccuuuuccccuguguccacuggccacaauccacaauauauuugaacuaauugcuauauucugcccaggaacuggugauuuguagcguacuuucacuuccuauagcguuuauacauuuuccccauuauuuguaucagaaaguaugucuuuuguaguauuuaauaaacuagagaugccucacuuauugguggaaugaaauauucuaagucagauuuucagaaaaaugaaguuuagacaaaguuuaaacacaaaacacaguauaauugcuuugauuaaaauccuuaaaaauucuuagcauaauuuaacugucaagguuauaauuguaaacauccaucauuacucuuugcuauaauguagugauguccccagagacuguugaaacuguuagccugcaaugcccugaguccuuuuaucuguuucuuuucuguucuuuuaguacuugugcuauugauaaugugcuuuuucuguaacagccauucuuuuacccuuuuauugucucucuuuuuuuuuagagggaggcucacucugucaccuaggcuggagugcaguggcaugaucucggcucacugcaaccuccgccuccccggguucaagcgauucuccugccucucagccuccugaguagcuagggcuacaggcaugugccaccaugcacggcuaauuuuuuuuuucuuuuuuuuaguagagaugggguuucacccuauuggccagguuggucucgaaguccugacuucaugauccacccacuucggccucccgaagugcugggauuacaggcgugagccacugugcccggccuauugucucuuucugaucugcaguucccuugcaaaaaauaaguaguugaaauaaguauuaagaaagucacaaaaacucaucaacuucagacaucaauuuuagucuccccugguuacuguauaaauaagcuguuaaauuuauccuuugauaucauuccaguuuaggcauaauuuuggcauuacaaguuuuaauauaccauugcagcaaaauaccacuuuuuccccgcagugugaucauucuuauccuauucuaaauuuucuuuuagguacgcaauaacuguuugguauuuugaugcagaugagagagcacgagcuaaaguaaaauaucuaacagguaaacgucauuuggggccaggauauauugguacagaaauacccugcaaucaggugaugcuuucaggaaacucaagcauagucuuuguuaacaccaugaauacuuacuuuuuguuuuuuaucagauuucuuauuugccucauuuuuuaagaagacauaagucaucuucacuguuaucuuuaaccaaaaaaauugucaaaggauguggaaaauuugaggcaaagaagucugaguaaauuauucacauacaaacugaguuuucugugauuauccuuuucagucaaaggccacuuaacucuagguaacggccauaugguuuccucucauucacuccuuaaauuaauacccuuuccuuuucaaauggaugugcucuaaacaguacucuaggucuuccauguuaaauguagacaugaagaaaauuaauacaaagaauuaugaauucaaaugccaaaaucaguaaaugacacagacauguagauuccauaucugcuaaugguguacauaggucagcacucuuguacugaaccugaagauccuuuaauuaugccaguuccccuucucuuccacuuauggacugccucuccaagagcagggggucuguuucccaucugauggaccacuuaccuucuuuucuuuaacucuacuuucuaucuccaaaaauccacugaguauucacauuacugauuagcuguguuuuccagagccauugcuaaucgcacgucgaccuuacauaaaaauggaauauucaugcauuuucuauguauuuuuaaagccauuauuuguggcacaagcucagugugcuuucagagacacugaacacucuguugaagaaacucaaauggcuuuuaaaauaaaaagacaaaaucauuaucucuguguagaggaugguuuuauccuugaagguuuacuauuugaaaccucaucacaauagaaugcugagggaaguuuuuggaaguacaagcgugauaguucucagaugauguuugcaaaguugaaauauuguccauacucuuaggaauucaguggaaugcaguagcagaagcucucuggugcuuagugaaugaaugaaaauuuuuuuuuuuuuuaccuugcaggugaaaaaggugugaggguugaacucaauaaaccuucagauucggucgguaaagacgucuucuagagccuuugauccagcaauaccccacuucaccuacaauauuguuaacuauuuguuaacuugugaauacgaauaaaugggauaaagaaaaauagacaaccaguucgcauuuuaauaaggaaacagaaacaacuuuuuguguugcaucaaacagaagauuuugacugcugugacuuuguacugcaugaucaacuucaaaucugugauugcuuacaggaggaagauaagcuacuaauugaaaaugguuuuuacaucuggauaugaaauaagugcccuguguagaauuuuuuucauucuuauauuuugccagaucuguuaucuagcugaguucauuucaucucucccuuuuuuauaucaaguuugaauuugggauaauuuuucuauauuagguacaauuuaucuaaacugaauugagaaaaaauuacaguauuauuccucaaaauaacaucaaucuauuuuuguaaaccuguucauacuauuaaauuuugcccuaaaagaccucuuaauaaugauuguugccagugacugaugauuaauuuuauuuuacuuaaaauaagaaaaggagcacuuuaauuacaacugaaaaaucagauuguuuuguaguccuuccuuacacuaauuugaacuguuaaagauugcugcuuuuuuuuugacauugucaauaacgaaaccuaauuguaaaacagucaccauuuacuaccaauaacuuuuaguuaauguuuuacaaggaaaaagacacaagaagaguuuaaauuuuuuuguuuuguuuuguuuuuuugagacagucuugcucuguuacccaggcuggaggggaguggugcauucuuggcucacugcaaccuccgccucccagguucaagcaauccucccaccucagccucccaacuagcugggacugcaggcacacaccaccaugccugacuaauuuuuguauguuuaguagagacgggguuuugccauguugccuaggcugggguuuaaguuaaauuuuuuaaaaaacuaaagugacuggcacuaagugaacuugagauuauccucagcuucaaguuccuaagauaagggcuuucuuaagcuuucagguguauguauccucuagauguagacaauaaugucccauuucuaagucuuuuccuuuugcuucuccuuaaauugauuguacuuccaaauuugcuguuauguuuuuuuccuaauacugugaucuaucugaucugcagacaagaaccuugucucuguugaagagcaucaaggggagauuauguacacauugaaacugaagugugguguuacugacggaaugugcaguaacuccucagauaucuguuaaggcauuucccagaugugaugccagccuucuuaccuguacugaaagaugcuuagcuuagaaaaaaacaaaacagaugcaaaaucagauaauuuuauuuuguuucauggguuuucuuauuuacuuuuuaaacaaggaaggaauauuagaaaaucacacaaggccucacauacauguuauuuaaagaaugaauugggacggaugucuuagacuucacuuuccuaggcuuuuuagcaaaaccuaaagggugguauccauauuuugcgugaauuauggguguaagaccuugcccacuuagguuuucuaucucuguccuugaucuucuuugccaaaaugugaguauacagaaauuuucuguauauuucaacuuaagacauuuuuagcaucuguauaguuuguauucaauuugagaccuuuucuaugggaagcucaguaauuuuuauuaaaagauugccauugcuauucauguaaaacauggaaaaaaauuguguagugaagccaacaguggacuuaggaugggauugaauguucaguauagugaucucacuuaggagaauuugcaggagaaagugauaguuuauuguuuuuuccucgcccauauucaguuuuguucuacuuccuccccuuccuuccagaugauaacaucacaucucuacaguaagugccucugccagcccaacccaggagcgcaaguugucuuugccaucuggucuauaguacagugcgcggcguuaggccacaacucaaaagcauuaucuuuuuuaggguuaguagaaauuguuuuauguugaugggagguuuguuugauugucaaaauguacagccacagccuuuuaauuugggagccccuguugucauucaaauguguaccucuacaguuguaaaaaguauuagauucuacuaucuguggguugugcuugccagacaggucuuaaauuguauauuuuuuggaaaaguuuauauacucucuuaggaaucauugugaaaagaucaagaaaucaggauggccauuuauuuaauauccauucauuucauguuagugggacuauuaacuugucaccaagcaggacucuauuucaaacaaaauuuaaaacuguuuguggccuauauguguuuaauccugguuaaagauaaagcuucauaaugcuguuuuuauucaacacauuaaccagcuguaaaacacagaccuuuaucaagaguaggcaaagauuuucaggauucauauacagauagacuauaaagucauguaauuugaaaagcaguguuucauuaugaaagagcucucaaguugcuuguaaagcuaaucuaauuaaaaagauguauaaauguuguugaaacauua

SEQ ID NO: 193026 - RNA, 100190 nt, Homo sapiens
aguccacagcugucacuaaucgggguaagccuuguuguauuugugcguguggguggcauucucaaugagaacuagcuucacuugucauuugagugaaaucuacaacccgaggcggcuagugcucccgcacuacugggaucugagaucuucggagaugacugucgcccgcaguacggagccagcagaaguccgacccuuccugggaaugggcuguaccgagagguccgacuagccccaggguuuuagugagggggcaguggaacucagcgagggacugagagcuucacagcaugcacgaguuugaugccagagaaaaagucgggagauaaaggagccgcgugucacuaaauugccgucgcagccgcagccacucaagugccggacuugugaguacucugcgucuccaguccucggacagaaguuggagaacucucuuggagaacuccccgaguuaggagacgagaucuccuaacaauuacuacuuuuucuugcgcuccccacuugccgcucgcugggacaaacgacagccacaguuccccugacgacaggauggaggccaagggcaggagcugaccagcgccgcccucccccgcccccgacccaggagguggagaucccuccgguccagccacauucaacacccacuuucuccucccucugccccuauauucccgaaacccccuccuccuucccuuuucccuccuccuggagacgggggaggagaaaaggggaguccagucgucaugacugagcugaaggcaaaggguccccgggcuccccacguggcgggcggcccgcccucccccgaggucggauccccacugcugugucgcccagccgcagguccguucccggggagccagaccucggacaccuugccugaaguuucggccauaccuaucucccuggacgggcuacucuucccucggcccugccagggacaggaccccuccgacgaaaagacgcaggaccagcagucgcugucggacguggagggcgcauauuccagagcugaagcuacaaggggugcuggaggcagcaguucuagucccccagaaaaggacagcggacugcuggacagugucuuggacacucuguuggcgcccucaggucccgggcagagccaacccagcccucccgccugcgaggucaccagcucuuggugccuguuuggccccgaacuucccgaagauccaccggcugcccccgccacccagcggguguuguccccgcucaugagccgguccgggugcaagguuggagacagcuccgggacggcagcugcccauaaagugcugccccggggccugucaccagcccggcagcugcugcucccggccucugagagcccucacugguccggggccccagugaagccgucuccgcaggccgcugcgguggagguugaggaggaggauggcucugaguccgaggagucugcggguccgcuucugaagggcaaaccucgggcucuggguggcgcggcggcuggaggaggagccgcggcugucccgccgggggcggcagcaggaggcgucgcccugguccccaaggaagauucccgcuucucagcgcccagggucgcccugguggagcaggacgcgccgauggcgcccgggcgcuccccgcuggccaccacggugauggauuucauccacgugccuauccugccucucaaucacgccuuauuggcagcccgcacucggcagcugcuggaagacgaaaguuacgacggcggggccggggcugccagcgccuuugccccgccgcggaguucacccugugccucguccaccccggucgcuguaggcgacuuccccgacugcgcguacccgcccgacgccgagcccaaggacgacgcguacccucucuauagcgacuuccagccgcccgcucuaaagauaaaggaggaggaggaaggcgcggaggccuccgcgcgcuccccgcguuccuaccuuguggccggugccaaccccgcagccuucccggauuucccguuggggccaccgcccccgcugccgccgcgagcgaccccauccagacccggggaagcggcggugacggccgcacccgccagugccucagucucgucugcguccuccucggggucgacccuggagugcauccuguacaaagcggagggcgcgccgccccagcagggcccguucgcgccgccgcccugcaaggcgccgggcgcgagcggcugccugcucccgcgggacggccugcccuccaccuccgccucugccgccgccgccggggcggcccccgcgcucuacccugcacucggccucaacgggcucccgcagcucggcuaccaggccgccgugcucaaggagggccugccgcaggucuacccgcccuaucucaacuaccugaggugagggcccgggacggggcacgcccagcgcguccgggaguagcgguuccguuggcggcggcggccgccaacccucagccccagccccagcgcaccgcugcgcuccccggggcggccggagagggugggcagcgggacacagcacaggggcaguugccucccuucuucuucccuccucuccucacucuuggggacacgaaggugggcgcagaauauacuauuuuuggggcgugccucccugaaagcuguuuuuuuguuuguuuuuuaacuuuccgaaucuuccagauuccgaagcagaaccaaccccgauuuaaaacgugcagcgucacacuagguccgcuguagcccaguggggcagaaagugcgcggcgaguugggggcuuuaugaaaugcuucuuucuuagaagaaggacguuuaccaggagugcuugucuuggagaggaguuaaggcaccguucccccgggaggggugggacuugagagguggccggccagaaccgaaagcagcaccaucuuagggauuugaacacuucaguggcucaguuuucuuaagaaucucaagauuaaaauuaaguucacgugggaaauguuuaaacuguggauuuaaacgccugucacugcauugcaccguuuucuuauuauugcuugcuauucacuacaauuuuuuuuauauacagguuuaaaaaacacuacuuugcauacugaaguaauggaauguaaaaaaagaaugcucuguuuggaaucuuauguugugaauaggcaaaacagugucaguguauuggacaauacuuuaaaaugacaaacauauacuugcuuaaguaagcaaugauuacaggguuguguuuuaaaaacucaaaaccaaaacauugcaaaguaccaucgaacuuuuaaagccaaaccauauuuguuuugacccagcauacagacaggaaggacauaacauuucauuugucaaagacuaaauuguuucuauauaaagaguuuuguagaaagauuuccuuuuaaccgacuuuaacuuucuaggacauaauauuauacacuaauuauuguucuuuuauauuggugcuacugaugaauggcuaaucauuugcaaguauggugaauccaguuacggauagucuauuaccaaguuuaguuugcaugucuuucaaguguauauauacaguucuguuuuuaaaaucuccuuucacccuguuaauacugguuuaagaaaccuuuaguauuagauaguggugcacuuaaaaauaaauggaguacuuuguuuugcauuucaaggccggauucagaagccagccagagcccacaauacagcuucgagucauuaccucagaagauuuguuuaaucuguggggaugaagcaucaggcugucauuaugguguccuuaccugugggagcuguaaggucuucuuuaagagggcaauggaagguaggcuccuuuccccugauccuuuauuauugguuuaauuguaaauggagaccaucuaauauuguauagauuucaauuauuccuuguuucuuauaagaaauggugauauuuccauauaauuuaaaauauaugaugacauuuuaacaauauguuuuuauuuaugauacucaaaauggaaugugguuggguacuauaauugcauacucuuugacuaacacuuucaguauuagacauaagucauaaaaaucuugaggacagugcuacuauuguuccuuaacugcuuagcuuugaggaaacagcuuuguucuaauaguacuuuuauauaucuauuauguagguauauguguaugcaguacuuuaaaauuuugauuaaaagaaaaaugguaguugacacauauguacauguaugcguauacauauuuguacauacacgaacauauaucacaacauguauaugaugcaguuuucuacaugauacugucuuuugacuacaugaauauuuauguaauauuuacaaagaaguaauucuaaacaaauuuuugaauucucuuuuuguucaguauauuuuuguaaguguauaagaggacaggauuaaacaguuuaaaauaaaaaaccuggacaucacaguaacauaauuucuaaagaaguauuuugcuuuaaguaaaacuuucauguuuuuaaacucauugaacuuacaugcuuaaugauuucagauuuacuugcauaguguuucagauuuuaacuuucaaagaaaauauuuuugaauuucuuucuaccuaaagucuaagcagccaaacaucuuuacauuugaagauaaaaauacauugaaagauuucauauuuuaauaccagcaauaaauguauucuauaacuauguaaaaugaagcuuaggauucccucuggagugcugagaucacaccuagacaaggaaccaaggaucugaauguuggcuuuuuguuuccuguucugaggauuuuuguuuguuuguuuguuucaacagcccucuccuuacaagcagaaaagcagguaguaggaaauuucacuuuaagggagcuuucaaaggaguucuucauaacaaauauuugcuuuguauauuuuuagaacaugauuuuuucucacaaaagaugaauguauuuuacugauguugaacauauucagcuuuaggggguuugauugcauuuuaaacuaauugaggcaguguuaaaagugguacuugagaaaauagggcaacugauaguggcucuuacccauugacauuauuuauuuacaguuacaguuggaaguucuuuguguggaaaagucaguuuuccaauggguaauuggaguuaccauuuuuaucugacuuugguucugguuucuuaaacauugccuucugcauuaauaugauuuccucucuucuuaaagucuccuaaggauaguauaauuuuauaagugaaugacucccuuagaauccucuuaagcccaauuuguccuaccccagcuccuucuuuugaaagauaagcaaaucucaaagacauaaauaugaguuuccaaaggucacaaaacuaguuaguagcugauuguuaguaaacauagguuaaauauuuuuacauugcagcgcuuguaaaucagagaugauaugcaaaaguagauauauaaacuguuugauucacagaaguuauuucauaaagugcauauauagaacaaagagcacccuaacuaaaauacaaaugcuuucucgucauuuuguuagaauagcauccaaaacuguagacgaagucuuuccaaauguacucuuagaaagcauuuguuggacuccggcuguuggcaugguccuauagucuugaguacuagaagugaagcaccuuuauuuagcaguaauuacaaagaguuacuuaagauugaugcagauaaaucauucaugaaacuagaacaagauuaugaacuacauuaguaaguuccuucauucagcaauuuaugccaaagauacacuuucccugacuucacuuuucucugccuugagauaaaaugaggauaacaguggcuauuucuuaggguugcuauaaagauuaaaugagcugauacuuguaaaguauguaaaagaaggccugacauauuaucaguuuccauugacauuucuacuuucaaggaacuuguaauauaguuagggagguaacauaugcacauaaaacaucuaaauaaagauucucaguaaaugcccaaguaagcaauucuguaauguauaugagaucugugugguuugugaguuuuuguauuuggacagagcgaggugguuauggguugaaauauguauauucuugaaugaugaagaagucuacauggaagauaugaacauuugauuaguaaaggacaaauaagcuuucuaggcauugaggagagcuuuaaguguauacagucaaagaagagugaagaaauuaagauuacacugacuaagcauugaauguucacauuaggaaauugagagaguuaaaguuugagaaacuagauugcuaguguuugggugaauuuggagaaucgguaauuuaaggcaagagaauauagagaauguucuaggaguuuucaggaaugagaaagauaaguagaaggacuuauaucagguucaaaaucuucaauaaagcaaugcugcgugaugagcugguucaagguggcgcuguguguggaugccaauauggccagaaguuuaaaguaaacaggcaacaauauggauacuaauguugccaaggaugagaaugaaaaugauggcauuauaaaaugcuuucucugugccagugacuauuucagugcuuugcaggucuuaacuuauuuaguuguuauaauguugguauuauuauuauuacucccacuuuacaaaugaggaaacuaagaccuguagauguuaagcugucuuaauacgcuuaggaaaugguaaagucaggauucaaauccaggugguaugaauccagaaucccggcccuugaccacugugcuuccuuucucauaauaggaaaugcagucaaagaaaaacaauagaggguuagaagaaaagaugugagccaagugaugaaacaucuaggaagguaaaagugaauccuaaaggagaaugcaagagcagggguaaugagaagugugugauauaaaaggauggaucauauuaacuucacauuuagggcagcaauaagaagacauaagcaggagccaacagccaguuucuucaccucccucccauguuaggagagggaggugauaaagccuauaaagucauucuggaugacuggguuucccuggauaugagacagaagagagaagagauaaagaaauaagauaccacucaggaaaugggagaaaggaguugggaaaaaugauuucuuuuaagcuaauugaacuguuuaggauauaguauuggccaaaaaccaguugguuggauagcccauugcauuccuuuaccaagacuuguagguuuggagugaaccaugaaaggaccaggaauugacuuaaugccuuccaaagagaggaaguaaucaugaccugccaguccuacaaaugcagacuacuaaccugguaugaugaaggaaaggacuauuucucaauggcuuaucuuugccaguacacaguaaccagcccagugcuaggaauauacuaggcauccaguagauaacugcuacaugauccagucaucauaacugauaacgccacacuuuuauuuuuuggaugcuuuacucagugacagcauuuguugugaauacauuugguguaauaucauuaaacacauguuauaauacaauugaaauguauuacuuagaagacacuaagcuaaguagguauugaaggauuuucaauuguauugcauauuaugcucacuuuuuuuuuuuuuuuuuugagacggagucucgcuguugcccaugcuggagugcaguggugugaucucggcucacugcaagcuccgccucccggguucaugccauucuccugccuuagccucccgaguagcugggacuacgggugccccccaccacgccuggcuaauuuuuuguauuuuuuaguagagaugggguuucaccauggucucaaucuccuaaccucaugauccgccugccucggccucccaaagugcugggauuacaggcgugagccaccacaccuggccuguccucauucuuuuauucauauauuaauuguucaugaaguaauuaccuuaauuacauuaguucauguauuuauugaguaccugccaugcgccaggcacuauguuagguacuggugaaaccacaguaaaacgagagaccuugcuggcuguugacuaaaguuuauaguguggugguggagagagacauuuuaccuauuuguguacacaugacuaauugcacaugugguaagugauucguuuaugcaauguuuggacaacuagagaauugaccccucugucagauaauggggaaaguuuuucagaccuagacaucacaauaaauagacugcagaggaaacuagacagaaaugaaauacuuuuaugaauaaaguguuucuuucaaaaguuggguauacuuggugucauaggcuaguaaugaaaacugguuugguagcauaguucuccuugauacagcaucagaaagagaaagauugaacauccaauuuuucaucagcaacuucugugauuuauuuguucuauauuuagagcucuguaaugcuuucuccaucuuuuguagugcacagaucauccagcaaucucuucuacuauaaucuauuugaauuugaauaauauuugggcucugagaagauauuuugccaauaaucuuauuuauauucauuuaaucuccaauagagucugcucuauagcagcuuucacauuacccuaaaaauaaauauguaguaauucacuagauuuuauuucaaaacucuauauccaauuucuuuucaagcugaggucucucaguuuacuauuuagcauggauaaugauagacugguuuuaagcaccacuuuacauuaggguucauugaaaucucuacuguacugaaaaagaaaugguuaaaaagauagcauuuggugucaucuguucauauuugguuauuuagagcucccagauuuuuaauacucuuucagaacauguacuuuaauaccacuacaagagccagaggagaagcagugguauuagccaugcgugcuagugcuaauaacugcuccuguucuggccacugaaucauuguacuuuaauuacucaaguaacacaaaaauccaucuccuuuaaaaaaugaaaauguuaucaauaaggcuuaaguccucuugaucaauaccucuaaucuguucccuugccuaccaucuuucuauaccucuaccucaguuuuucccauguguauguguguguggaauauguucucugggguauguuaauauauaaaugguauuauauaucauaauuuaugcaucauguuauuuugauacaaaaaugacuugaagcucuauuguucauauauguaguuccaacuuguuuuuuuaaccacugcuuaauauuucauaauaugaaaaaucauuauauuuaggaauuacuaauuacacuauuacuugaguaaacccuuuuuguacauuucuccuuugguacaugucuugcuucucuuuccagaauauauugaaguauuuugauacaguucuaaaugaacuagaugauuagcuuucuaccugcugcuaagaugauuugauucacuaauuuauucacuucagauacauguauugauccuacauuuaaaaguugcuugugcugggacugaagaugaaaauguaugcagacccugucuuugacaugcacaaaaccaagaagaagaaaacaaaacagaacaaaccugugguacaacuagugaacaugagaauaccuugauacaaguuaugccagagccguggccaacacaccguaguauucaguuagacacauggagaagaauggcaguuuauucugcuaacauaucuugauguugugcaagaggcuuauucauuuaauagucacuuaagucgccuucacuauaacccaggcacuguuuuaacugcuucacuggauuagcucaauuaauccuuguaagaguccuuugagguggagguucuguuaguaucuauauuuuacagauggguguaaagagagguuucuacuauucaggaggucugacucuaacuucuguaucuuaaauuccugcuucugugcuguuuuccuagacuguuuuguauuugagcaaauauuaauuacuuuauacuuuuucagauaaauacauggucucuuauaggagacugguuuucaaauugugcuccuuaacucagucaaguuccuucuucuauucagaacagcucuguauuucuuuauuugguuuauauuuccacuugagauuuuuauugggacaaaggauucucagccaaccuuuuuuuaaaaagcacuccuuuauaacaggaaacccuuagaucucaaucaaguauuuauucgagugacuccuaagaaguuuuuuggcucuauuugcugguaucuuuuuggcauuugugcaaagacgagaugaccauuugugaucaagauuuaaaguccaacugcucacucuucuaacagcauggccacauuauuagccgaaaaucacaucugaguuauagagcuuuugcuuuugucagaaaaaaaacaaaguaacuccagggaaucuuuuaucagucacuucuuuaaaggauugauugaaauaauugacacuuaagacagacacucaaaaauaggcacacuaaucauuuacacaagggauuuccaaccccuaggauguggacugguaccacagccaguccaugguccggugcgggcccauggccuguuaggaagugggccacaaagcaggaggugagcaguggccaagcgagaauuacagacugagcuccgccucccugucacaucagcagcagccuuagauucucauaagagugagaacccuauugugaauucugcaugcaagggaucuagguugcgcacuucuuaugagaaucuaauaccugaugaucugugguagaacaauuucauccagaaaccaucccacaccauccauggaaaaauuguauuccacaaaacuggucccugauaccaaaaagguugaggacugcugguuuacaucuugguuuuuaaacuccauugucauuuaagaacaucagaaagucacauacucuguauaucuucccuaucuaccuaauuugaggagaggccgaugaacacaauauccuucuuguggcuagauggcccucauauaauuaacuauauaaugcauacuucauauaaucuaucaucaagacauuuuuuucuccucugaugagauauuaugcuuuuuaauaagugauauguaaauagccuauuggguuuuccuuuuuauuuuaacuccugcaaaacaaguacauuuuaaugcucaauuuuaaaaaauuaacagguuuugagcuuuauuuuuaacugcuacuacagcgucuuguguuguguacuuuauaugacauuuuaaggaaucauaacuuuuuucuuaaagcauaguauuuacuaguaaucauuauuucuuuaggaaaaaaaugcaaauacuuuucaugcuauuuacucuucuauaaccaagugauuuauuuaugagauagaauacacauguagugaguauggaccgugagcucaaaacagugcuguagcauuuguacgaaauauaaaaauuaaaggguaaaaauaaugguuaucauuuauugaguguuuacuaaauucagguacucuucuaaugucucuuuguuuacuaacucauuuaacucuugcaacaaaccuaugagacagguucuauuuuucucauuuuacagauaagauuuguucaguuagucaacaguagagcagaacuccacuccuggagucaaugcccuuaacuuccacuggauauuccuuugcaggaaaagauacagucuuugauuucaaggagccugcaguguguguguggaagugagugauuaacagacaacacugcaaauuuaguguuugauuaaauuguguguugcagacuuagggugcuauaagugaacuagagaggaaaguaccaagaguugucauuacugauugccuauauauaauagaaaccaugcuaaaugcuuuauauuuaauauuucuauucuucacaacaauccuaaaaaguagaauuuaccauuuccacuucauauguaagcaaagacucagaaguuaguuaacuuaccccaauuaauaguaguacuggcagagaugugucugcaguaguuagaaaagguaguuuauugagcuaguaagauuuauucaaagccuuuaaaaacagagacaguaauuaagaaacguuuauuuuugauaguuuuuuuaauauaauaauauugugacuccuggcguauuauacacaagaaaaauuucaggugggucaacaacuuaauuuuuuuuuuauuugaagaaaagaaaccuaaaaguauggaaagaugauggagguauguauuuauagucuugggauggaaaacuuucuaaauuugauauaaaauccagaauucaaaaacaaauuugcuccauuugcuauguaaucucaaauuucuuauauaaggcaaaaaauucauaaagucaaagacaacaacaaauuaggaaacuguaacauauauguaaaucaaaaggaaauuauuacccauauacaaaauauucuuacaaaucaagaaaaagacaaacaggaagaaaaaugaacaaaaaauauuaagacaguucacaaaguacagcccacagaaguaugaagaaggcucaacucacuaauaagcauuacugauuaaaauaauaaugggaauuucagcaauuugaguacuggaauaauaaugaauaacaaauaaugaccauuggagaaucugaagauaguuugguauugucaauuaaaauaugcguuacuuuggcccaacaauucuacuucuagaaacucauccuuacagaacucuagaauaccuguagguggauguuuauugcaguauuacauuauuuauaauacugagaaacugaauacagcccaaaugucuguuaaaaagagauuagcaaauugugguauacccuugcaaugaaaagagugaguuagcugucuauacuacagaugucaagaagucucuaaaauauuugauuuuaugaaaaagcaaggaacaauaucauucuggguaaaaaauuguacccauuugaucuugcuagguauagagagcuaucuaaaagaaaauaacuaagugcuuacugucaggaugagagacuuccaauuucugaugacauguuuuggucuuuuuuuuuuuuuuuuuuuuuuugagguggaaucuagcucugucacccagccuggagugcagugguuugaccucagcucacugcaaccugugccucccugguucaagugauucuccugccucagccucccgaauagcugggauuacaggugcccaccaccaugcccagcuaauuuuuuuauuuuuaguagagacaggguuucaccguguugaccagauuggucucgaacuccugaccucaggugauccucccgccuuggccucccaaaguguugggauuacaggcaugagccacugcacccagcuucauucuuuaagcaaguauuuacugaaggggcugcaauuacacaccaacuuggugccugacuuuccuccacacuggccccgccuagucucagcuagccucugcugcccuaaugguguccagugaccauaugugccacuuuucaccuucagguacccuagaauguugaaagagacuaacaaagaaugaaacuugaagaauauugaagcaaaagcuugagguuacucuguaucaugaauuaaggaauccuuccugacuagauggagccaagaauggacacaggcccacaauuccucacacacaaucucaauauucaaaaagcacugcaaacaaaaauuuuguuguagucacuugucaacaauaccuaaccugacgugaauuuguuuggcagcaaaaucugaucugaaaucacaugaggaaaucuuguagucuauguaaauauucguacauuuugcugcauaaauauaauguuuuauuaaguguugcucuauuuuaucuuucuaaaauacaaacaauuuugaauuuugaaacacaauuggcccaauacauuucagcuaagagauuuuggacauguacucagaaaugauuuauagacuauguugagaguggugccugcuggcuuuuugcaauguagcagcccugaaaauuuuuauaaacaauucuuaucauuuauucuuaucuuuuuuuuuugagagggaguccccgcucuguagcccaggcugaagugcaguggcacaaucucagcucacugcacucugccuccuggguucaagcgauucuccugccucagccucccgaguagcugggauuacaggcauguaccaccacacacacuaauuuuuguaguuuuaguagagaugggguuucaccauguuggccagguugcucuugaacuccugaccugaagugauccucccaccuuggcaucccaaagugcugggauuacaggcgugagcaacagcgcccagccuauucuuaucauuuuuaauaaauucuuaguaccaugcuggguucuacagggagcuauaaaagauaaauaagccauauuaccuaacuucauauaguuuucguucaaucauggaguuuaucccauauucaaguauaauauagguaauauauaaaucaaauguguuuuugauuucaaggggaaaaagaucauauuuagcuagggagaccaaaauguguuuuuauggaaaggauagcaugcuagaugggcugcugagaaugcaugaaauuuuugauagcaagaauuguaauggcuuuuguaaacaaaaacuacagacugagcagaaggacaauuuggcuaaagcauggaacauggucagaaucccuuacgauuauauauaaauuauuuguguuuuuucuaggauaauucuuuucaugagguuuugaaagagaucagugaccccuuauucccacccccaaaaaaguuagcuuaccacugcuuuaaaggaauggugaggauuauuauaaaacagaaggucaagaaaauguggaaugcacaaugggguguuuacaauuaauugaguaaagagugagaagccccuaaauauuuuuugggcaguguaguggcauauuuuaauauuuaagaaaauuaguauaucagcaguauauuggaaagauuaaugucagaaagguaagggacaaggaaaacagucuggggauggugcacuaaggaccugagccaggguuguggagagaggaauggguucaauggguagauuggaaccaauugagaagggugaugaaagcgacacagagaauugugggggugggggacgucaccuucagaaauaggaaguacaugaucauuuuacucaguaaaggagugauguugaaaguaguauuuaggaaggauuauccuaaaagcaccaugcagaauauauuuguacagagauuagauagcuugaagucagagagaacagcuaggaaacugguaacacagauucugagaaguaguuuaauuucaaauuguuuguauuauauucuacauaauguccucagcaggauauugaaauaauauaauuuuugugcacaaaauaacuuaugagaauugagauguucugguuugucacuucauuuagucgucugcuuauuuauuaauuuauaccaaaaauaaugccguuuugugccuggauuuguguuaaauauugagacucaaaaauggaugagccaaguucauaacuuaggagaaaggcacauaaacacguugcagaaaugcagucugguaauaucuaugagaggugugagcugagaauuguggaaguauaggacaggaagaucuaacccugguguuuaaaugcgggguauggaaggagaaagucugaauccugacuaaguauuagacuaaaaauauuaaaucuuaaaaauuauuguaauuucaaaguuuguggcaacuuuuuuguaauuaacaguggagaccacaaugguuuaucuucuuuaagcagagcacuucagugaguguuucuuugugcaaaggcccauccagaggccacuuuggaugggggggcggaugaaaguaugaagaacugaaccucucuauguacuauuuuaauagaaauuagggaauuguaggcuagcagcuggggcaaggaguaggaaauagaaagggccuaacaacugaguaggaagcaagggcucaaggagaguagaugccugugagaauuucccuauugcaggcaacaauccauaaaucccuaggcugguagugccugauagcaaacuuggaauuguuuacuaucucauguuuuaauuaccuccagcuaccucccaacccuuaaguaaauuuuugcuguuuacauuuuccuuuauaaaaggauaugcauuucagauugcugaccuuuccuaugaugacaagugucucaguaguaugauacuuagaagauauauaggccgggugcaauggcucacgccuguaaucccagcacucuggaaggccgaggugggcagaucacgaggucaggagaucgugaccauccuggcuaacacggugaaagaaaccccgucucuacuaaaaauacaaaaaaaaaaaauagccaggcaugguggugggugccuguagucccagcuacucaggaggcugaggcaggagaauggcaugaaccuaggagguggagcuuacagugaguggagaucacaccacugcacuccagccugggugacagagcaagacucugggaaaaaaaaaaagaagauauuuagcagaagguacaguuaaucugccccuucaaguuaaagauaauguucaugauagaaaaaaggagguaacuucuguuugaaagacacuguuguuuuguagauagcauuuugaaaacaagucuuuggggaugauuccacuguuauuugauuuuguugugaagguauuauaagagaucaaaauuuuauaguuucauacauaaacauuuugaaauaagauuuucuaacuugcuaaaaaaucuuccaaaaaaauucaguuagguucugaacacauuucauaauaguggcauuuauugaacacauaugucaggaacuuggcuaaauguguuauauuaaacacaaagauuuuaaaucacuugcacagauaaauaguaaauaaaaugguagagcugagauuggaacccacagaaccuucucucuuauuuguuaauauuaccucuuauucauuaucuagugucucuuuguccuaaguauuuguaaugaaaauugauugacaucagggagaguagauacuugcuagcugaauuucugggguaaaagaagcuuuucauaacugguauguggaauugaaagugaauauuaugacuagauaaucugcccugcagacaguccccucauucuccauggcuucugggauggcugucuuccaccuucucuucucagccugccagcacuccccuguccucacuuucagcuaacagccuugcuuccuaauuuucggaaaaaaacuuucugaaauugcuaccaccaucuguauggacagaaguggccucugaacuauaaucccauuuuucugggguuaccagagcucugcaguucucaaguccagcccucucuccuugaccacuagauccagauuacuccugcugacucaaggacaggcucuaccaauccucccgcaacauuuaaaucauuuuuccccuucucuacuggauaauuccugucagccuacaacaugcucuuccuuuucucaucuuaaaauauaaacaaacuacuuuuguugauuucacuuacucuucagccaccaaucauuuuucuucuuuuacagcaaaacucuucuaacacauuuucuucucccauucacucuuaaaccuaacccaaucaguuguugaccucugucacuccaccaaaacuucucuugucaagguuaccauguuacuaaaucuuaugggcaauugucagucccauguuacuugacucauugguagcauuugacaauugaucacuccaccuuccugcaaauacuuuauucgcuugguuuucaagacacgacccucucuugauuuuccucacuagcuccccuucaaacuguucuucuccuuuagcuuuuaauaugagaggguccagugcugaguauucugaguauuugguccucuucccuucuguuuauauacuuacuuccuugguuaucuaauccagucuccaaacuguggauaaaccacccaaaauccaaucacuuccaaauuucuaucuccagcccagaccuuuccccugaacuccagacugaauaucucaaaccaacacaucccaaaguuggcuccugaucuacuuaggguuuucucugguaagccaguguucuuuugguccucaagcuaucugccucagaaucaccuggguacugguuugagaugauuucugcaccucgccccagguaagccaagucaaaauaucuaagaaagggacccagaaauggcauuucagcuagcuguuugguuguuucuuaaaguucugcuuggcucagaggggagccagauacaaagcugagaggugaaaugguuggcuuuguuuuugagaacauuaacucuagaagcaauggggaauagaggcagaaggucaugccagggagaucagaccuaagauuauuuaaaauacucuuugaucgagaucugggggccuucagucuuaugcugagaaaacacuacuuuucauucccuaaagcagugaaccugaaauauagaaggcaggcaggcuguggccccuaccaagaaugcuccuuucucuaggaagaauucuaaaaaaugugagaggcuagggagggagguuggagacuuccacuuuuuguguccuuacuauauaccaggcacuauaguagacacauuauauguauuuguuauaggcauaccuuagagauaucgcagguucuguucuagacaacuacaauaaagcaaauauugcaauaaagcaagucacacaaauuuuuugcuuucugguaucuaaaaaaguuauguuuacacuauacugcagucuguuaagugugcaguagcuuuaugucuaaauaaacaauguacauacccugauugaaaauacuuuauugcuaaaauugcuaaugaucacaugagccuuaagggaguuguaauguuuuugcugguagagggucuugccuugaugugaauggucauugacuuaucgagguagugauugcuggagguuggggugucuguggcaauuucuuuaaauaagacaacagugaaguuuaccauauccauagacuguuccuuucacaaaagauuacucuguaguaugcaaugcuguguuuuacccacaguagagcuucuuugaaaauuggagucacuuuucucaaaaccugcugcugcacuaucaccuaaguuuauauaauauccuaaauccuaaaucuuuuguugucauuucaacaaugcucacagcgucuucaccaggagcagauugaaucucaagaaaccgcuuucuuugcucauccaugagacaagaccccucauguguucaaauuuuaugagauuuuagcaauucagucacaucuuugaacuccacuucuaauuccaguucuuuugcuauuccuaccacauaugcaguuacuuccuccaugaagucuugaaucccucaaagucaucuauaaggguuugaaucaacuucuuccaaacugcuguuaaugcugaugcuuugacuuucuccgauuaaccacaaauguucuuaaugacaucuaaaaugaugaacgcuuucuaaaagauuuucaauguacuuugcccagauucaucagaggaauuacaaucuauggcagcuguagccuaauaaaaugaguuucuuaagucauaaggcuugaaagucagaauuacucagugauccaugggcugcagaauagauguuguguuagcaggcaugaauacauuaaccuucuuguacauuuccaucagagcucaugggaauuuuuuuuucuaagcaguaggucucaacagugggcuuaaaguaguuaguggaccaugcuguaaauagaugugcugucacucaggcuuuguuguuccauuucuagaacacaagcagaguagauuuagcauaauucuuaagggccuuaggaacuucagaaugauaaaugaggauuggcuuuaacuucaaaugcccagcuucauuagccccuaacaagagagucagccuuuccuuugaagcuuugaagccaggcauugacuucuccuaucuagcucugaaaguucuaaauggcaucuuuuuccaagagaagacuguuuuaucuacauugaaaaucuguuguuuaguguagcuaccuucauccaugggcuuagcuagaucuuuuggauaacuugcugcagcuucuacaucagcacuugcugcuucaccuuguacuuuuguguuaugggaauggcuucuuuccuuuaaccucauaauccagcuucuguuuucaaacuuuucuuuuacagcuuucaucccucucucacccuugauagaauugaagagaauuauggccuugcucuggauuagguuuggcugaagggaauguuguggcuggcgugauccucuauccagaccauuaagcguuucuccauaucagcuauaaggcuuuuuuuguuuuguuuuuuugcuuucuuaucauucauguguucacuggaguagcacuuuuuaacuuccuucaagaacauuuccuuugcauuuacaacuuggcuaacuggugcaagaggccuagcuuuuggccugucuuggcuuuugacauuccucccucacgaagcuuaaucuuucuagcuuuuaauuuaaggugacacauaugcaacccuuccuuucacuugaacauuuagaggccauuguaggguuguuaauuggccugauuucaauauuguugugacacagggaauaggaaaucaugaagaaagagacaaggacagaaugccaauugguggagcagucugaacacacacauuuaucaguuaaguuuauugucuuacaugggcaagguuuguggcacccaaaaacaauuacaguaauaacaucaaagaucucugaucauagaucaccauagcagagaugauaaugaaaaaguuugaaauauuuugagaauuacuaaaacgugacagagacaggaggugaacaugugcuguuggaaaaaugaugcccauagucuugcuggaugcagggcugccacaaacccugaauuuguaaaacauacaauauuugugaaguacaauuaagcaaagcgcaauaagauacgauaugcuuguaucucccuuaauuuucagcuaagagcuguuugagaaguuacugccaucuccuuuuuucagauauaagaauuaaaacaaggaaggaaguuaacuuuccuaaagauaccuagccaguuaguaauggagcugguaaccaaacccaguucuggcagacuccaaaaauuaaaccgcuuucacuaaagcacaccacugggcacuguguuugaagcacgagaugauauuagcaacugauugaagauuuauugaaaagacuuaaaacucuuauuguagucaagucguuuaaaaauauuuuuuacuuuuaaaauuuauuauuauuuagagacaggcuggagugcaguggcaugaucauagcucacugcagccuugaacuccugggcugaagugauacucccaccucaaccuccagauauuuuuuuaauagacaaggcuuugcuuuguugcaggcuggucuggaacuccuggccucaagcaauccucccaaagugcuggaguuucaggcauaaaccaccuugccuaggcucauuuuuuuuuuuuuuuuuuuagacggagucucauucugucucccaggaguguaauggcacaaucucugcucacugcaaccucugccucccagguucaagugacucuccugccucagccuccagaguagcugggauuacaggugcccaccaccaagcccaccuaauuuuuuuauuuuuaguagagacaggguuucacuguguuggcuaggcuggucucaaacuccugaccuuaagugaucugccugccucagccucccaaagugcugggauuacaggcgugagccacugcaccuggccaguucaaaucuuauauauuuuggugccuagacuuaaauaacauuuaggaaaauguuaauuaauuauccauauaguucuaccuuuuucuuucuuuuuuuuuuuuuuuacaaagccaguuucaaguaagacuggggagauucuagaaaguuauaacagaaucuuaagucacuugauaugccuaaacagaauuugaagaaauaaugaaguugaacacauugauaaacuuaggauuucuguaaucaggaagaaaaaacuaaacuucauagauaugagggaaggaauuaaccauuugcauguauguaacuguuauaauccuacaucagaguagcacaaggacaugaacaacuuuguugacaaauaguuuuguaauuuuuuaauguuuuuuauguagcugucuuaaacuccuuucucaauaguaugugaggucaaaugauugugguuucuuuuuaaaauuuugcauguaauguguaguuccuuacauucucuaaaugcuuacuguuuagcuaacuauguuauuauggaugucaauuauaacuaaguacuucauacaauuucacguuuuauaaguuagaagauaugugaauaauuagggcauuuggaagaguuccagagagauuuuuuuauuuagaaagagaggagcagaacagcuucaggaaagauagaugaaaagcugauucauucaauuuaagauaguugaagggaagaaaaaagaacacauuauuuagaaugaugacaugaagaacuuaauuuccuuuuuuuacuuauacuuuaaguucugggguacaugugcagaacgugcaguuuuguuacauagauauacacgugccauggugguuugcugcacccgucaacccgucaccuacauuagguauuucuccuaaugcuaucucuccccuagccccccauccccugacaggcccagguauguaauguuccccucccuaaguccauguguucucauugcucaacucccacuuaucagugagacaaugcgguguuugguuuucuguucuuguguuagcuugcugaugaugguuuccagcuucauccaugucccugcgaagaacaugaacucauucuuuuuuauggcugcauaguauuccaugguguauacgugccacauuugcuuaauccagucugucauugauggacauuuggcuugguuccaagucuuugcuauugugaauagugcuucaguaaacauaugugugccugugucuuuauaguagaaugauuuauaauccucuggguuuauacccaguaaugggauugcugggucaaaugguaauucuaguucuagauccuugaggaauugcugcacugucuuccacaaugguugaacuaauuuacacucccaccaacaguguaaaagcuuuccuauuucuccacauccucuccagcaucuguuguuuccugacuuuuuaaugguugccauuccaacugccaugagaugguaucuuauugugauuuugauuugcauuucucuaaugacuagugaugaugagcauuuuuucaugucugucggcugcauaaaugucuuuuuuugagaagugucugcucauauccuuugcccaauuuaugagguuguuuuuuccuuguaaauuuaaguuccuucuagauucuggauauuaguccuuugucagauggauagauugcaaaaauuuucuuccauucuguagguugccuguucccucugaugauaguuucuuuugcugugcagaaguucuuuaguuuaauuagaucccauuugucaauuuuggcuuuuguugccauugcuuuugguguuuuagacaugaagucucugccuacaccuaucuccugaauaguguugccuagguuuucuucuaggauuuuuaugguuugcagucuuacauuuaagucuuuaauccaucuugaguuaauuuuuguauaagguguuaggaagggguccaguuucaguuuucugcuuauggcuagccaguuuucccaacaccauuuauuaaacagggaauccuuuccccauugcuuguuugagucaaguuugucaaagaucagaugguuguauaugugugguguuauuucugaggucucuuuucuguccauuggucuauauauccguuuugguaccagugccaugcuguuuugguuacugcagccuuguaguauaguuugaagucagguagugugaugccuccagcuuuguucuuuuugcuuaggauugucuuggcuaugugggcucuuuuuugguuccauaugaaguuuaaaguagcuuuuuccaauucugugaagaaagucagugguagcuugauggggauaacauugaauguauaaauuacuuugggcaguauggccauuuucacuacauugauucuuccuacccaugagcauggaauguuuuuccauuuguuuguguccucucugauuuucuugagcagugguuuguaguucuccuugaaaaggucccuaaaacuucauuucuaaaaaaaaaaaaaaaaaaggaauaugcuaccaaauaggauucuuuaaaucaauugucuccuccuucagaaaacauccagaaccugaccucuuaucaccaccuccacugaccacuuugguuuaagccacucuuauuccccuucggauguauugcaguggucuccugacagucucauuucuauccuuaccuuccuagauuccagagguugagagucugcccucgacuuagaagccauugugauacuguuaaaauauaagucagaucauguuagccgucugcuccagugucuccagugguaccauaucuuuuagagaaaaaucaaauuucuuacaguggccuucaaggcccuacagcaucugcacucugcugcacucugauuguacuaucuacuacucuucucccuggcuuagccagcucuagccuuacucacauccucaaacaaucccugucaucucuuagcaucuuagcaauuucuucuuuccucucuaauuccuuuccccaacacuccccacuucuccaacccauuccagcuuccagcuuccagcuuccaugaguauccugaaacauaacaaacuuugguuacugccagugucucacuuaacacauucccccacuacaguguugucaaguuguuucauuuaacaccaguaacauuuaauaucaguaauagccagauucuaucuuaggaaaaauaugccuaaaauuuauuugcugaaaaaaaaagaaaagaaaaauuuggauaauaaucugcuuugaguuauuacaaacacagcaguaucugagaagcaagacugagugucauaaggaaacaaccagauuaaauaaaagcauagcuggaugagauaagaaaauacugcagugugauccaaaaugcaguaacagaguuaaaauccauauuggucgucauaaagagcaggaaauaacaccaauuauguagaguucacauuuaaggaguuacuucggaaugaagagaaauugguaaacuggugaaaauuacacacuaugauuuauuguuuuuauuauguaccagucauugugguaacauuucaucuaauuuagcucacuuaauccauauaacagccuuauaaaauguuuaucucuauauuauaugugggaaaaacuaagauuuugauuaaacaauuuuaucaugcugcagaaagugacagaacugaauuugaaugaaagucuauuugacucuaaagcauauggccuuaucacuaugcuguuggacaacagauacgaugaauagagagcacauaugcaacccauaaauauccagugauucugaagaagaaacuaaaaaacaaggcagcaaaaguauuaauugauuauagaaaaugacucuuccuuauguaucuuuuuuacgagaucauuucuacauugugucaccagcaccuagaacaauguuggcacauaguagauauucaagaaauauuuguuuauugaacugucauaauuacuguuaagcauuuauucugugucuguuauggugcuauagauuuuauauacauuauuuuacccucaaagcaacuuuuaaacuguuauuuuauagaugaggauaauguagugccaagaaguuaaaugaucugcucaagguuauauagcuaauaauaggugguagaacacguauaacagaaguaaguuuagcaguuaaauaaaaauuuuacuuuuuagaucaaaaggacucacugcaucccagguaaauguaauuuuaaaaagcuaaaacuuugcaauauugguaauuuuuuaaaauuuuucaugagaaggaaaaacacccuauaugcauuuaaguaggauuaauaaaacugguuaacuacuaagacauaaaaauuggguugacauuagauuuccucuuugaguacuaaaugcugagauuggcaaaaauuccaucagguugaguugcuauucuugggugaagauaacauauauucuuauauaugugagaggucaggaauaugcccagucuuuaccgaaguacuuguuugucugaugguuggacuaauuugggauuccuguaguguccuguaguucagggugaaguuuaguaacaugcggggguaagagacaggaggugcuauucucugcccugcugcucaccagugugcuguaucccuccucaggaucacccuuaaggucucagaugcucacaccugguguucagugcccaguggucuguucucuagccaguauauucugugucgucuuagauuccaguccaaagacuauuuagaucugcuccauccuugggaauuuccacgcacuuuauuauuucuucuagggcagggguccccaaccuagaacaagccuacgauuugugggucauaccauacugacuuucaccauuucacuccuugaacuauugaacauacauuaucauuucuccugccauuuuacucaccugcugcucaccuccugcugugaaucaggccacacagcaggaggugagcagcaggugagugagcauuacugccugagcugcaccucccaucagaccagugguggcauuagauucucauagcagcgcaaacccuauugcaaacugcgcgugccagggaucuagguugugcuccuuaugagaaucuaacuaaugccugauaaucugaaguggaacaauuucauccugaaaucaccgcuucccccaaccccccccaccccucacugcccccaguccguggaaaauucgucuuucaugaaaccugucccuggugcaaaaaagauuagggacugcuguucuagagaaauuaaauguuuuuaugucuacuuuguuacaagguuacaugaaauaaaccaguuaaaugcuuaguauauuggucucuaauauacucaauaagauuuuccuucucuccuucaccccacaccuuuuuccuucacuuuuaucaaaaauccuuggaucuucaugaagauauuuuaaaaccuacugauuuguuauuguccagcugucuuucacacucugcuagauagucacucuucauuccacuuuacaugaccauccccugacuuacuaacgugaaaaacuggucugaaccuuugucucauucugcaugcaucuucagaauaugcuggauuccagaaaacauacaaaaaacuuuaaggaauaguacagcgaauaucuguaaucaacaauuugaagguaaguugcagacaucaugacauuucaccucuuaaggcuccaaaauucauguccuaaggacaagaacaucuuccauuacaaccacaauauuaucaccccaaaauuuuaacauugauaaaacaauucuaauauucagcuaguauuaaaauuucuucaguuuuucccaaaauguuuuguauagaauguuuuuuuauucaggauccagucaggaauuguguauuuuacuugguuagcaacucuguuuaguuuucuuuaaucuaaaaagaucucccaccuuuuuuugucuuucaggacauuggcauuuuuuugggagucuaggccagccguuuuguagaaaguuccauaaucuggcuuugucugauuuuucccccacauaauuauaugccaguuaaacguuuugacaagaauccuacacaggccaacgguucucagacacugaucucaugacccccuuaugugcuuaaaaauugcuacaagcccaaagagcuucuguauacgugaauucucucucucaguauuuacuguguuagaaauuaaaacucauaauguuuuaaaacuuuuuauuagcucauuuaaaaaacagcaaacccauuagauacuaauuuuucaaaccaaaaaauuuaaugacaagaaugacauuguuuuacauuuuuauaagucauuuuaaugucuaucuuaauagaagacagcuggauucucauaucuggaucuacagucaaucuguuccaauauguuguuuugguggaagcaugggaaggaaauguggccucacacagauauguaguuggaaaauggaggaguauuuuaauugucuuuucagacuugacaagugguggccauuucauuaggaauugcaaaaggaugauucucuauuucuauuaucccuucugauuuuaucagcuauaaauauuuuuaauaguucucucucucuuccaagaggcaaucugguaaucuuaaaauacacuuaauaauggaaagccuaacagauacuuauuauuuacuuuuaauuuucaguuuucaaaguuguuaaguuugugcccuaguaaucuccagugguuuccagugaguuccucuuguuucuuucauucuuucucuucuuacauaucauuauguacucauguuuuuuaaaauauauauucaauguguuuuaauuacuugaaccaguucuuuuugauguucaagugguuuuaauuuugguuggugugaauuaucaguggucaaugaaacacaauuuuauuagcccucaguaaaagcaaaucaucugucacagcaaagcaucccaggcucaacuugcacauuuccugcccuaguccuggaucagucauuuccccaaggagcucugguucguuuuagaugaaaauuauauuacaugugaaaaucugaauuccugcuggaguugucuuuacuuuugggcauuuucagugaagagaccuagaaaauaccucuuuuugaaaaaguaaggggaucaugaguuuauaccaugauuucucaaccucacacuauugaccuauugggccacauaauuguugcagggggggauguccugugcauuaugggauguuauuagccuuuuuggccucucugcaauaauaccuacccucuaguugcauaaaccaaaauugucuccagauauugugaaauguccuggugaggaagggagcaaaauugccucuaguugagaauuacugguuuauguuuguauuucuagcaaaaucaaaauaauuacuaguuguuuuaucuguauguauuguguguguguguguguguguguguguguggauucaaaauacuaguaucagcauuauuaccucuaacaacaaaaccugcuuuguagacuaguucuuccaucuccugcauaaaaucuuaggccagucccaaagauuuuaaucagaagaacaaucucauuccacuaaccguauuagucuguucucaugcugcugugaagaaauaccuaagacuggguaauuuauaaaagaaagagguuuaauugacucacaguuccacauggcugggaaggccucaggaaacuuacaaucauggcccaaggggaaguaaacauguccuucuuuacaaggcagcaggagagagaaugagugccaguaggggaaaugcuagacucuuauaaaaccaucagaucucaugagaauucacugauugaucacacugcucaugaugaucacgagaagagcauggggggaaaccacccccaugauucaauuaccucccacugaguuccucccacaacauggggggauuaugggauuacaauucaagaugagguuuggguggugacacaaagccaaaccauaucaguaaucaaaaugcccagggaagcauuaugccaaauuuacaaauccucuucuaaguuuagauuucuucuuugccccaauucagcacucacugcuuugagcuugaagccuaaagggaagaacaaauaagaucugcuucuucucuguuuaugcugccuacacucacccaaugacagcugauuuugacccuuccagggccaacgugugggaagagaaguuagagagcacaguuuuacacaacaaguaggaauuuuagugucacugggguuaucuguguuuggugggugauuacaggcugcucuuccucuagugggauacuuuggugagauucauggagauacuuuacugagagccucuaacuguaauccuguaaugcuguaaugcaguagacaccucucuucucucuggacaugaccgugacccucugcuucuggacuuccgcugacugacccuacacagauucuguuggaucacaauacucucuagguuguccucuuagcuggagccaguuuuuaaaagaaagaaacuuuuauugauaaauauuuucagaaaagcacucaaagauguagagcuuaucaguagguaaaugaaacgauguuauuaucacccagaccaaaaaauuuaaagaucauuagguucccagaagcuccauuuugccccuuccaaucauuccccaaaaguaaccgccaucccaauuucuaacaugauagauugguuugaacuauuuuagaacuuuauauuaauggaaucagauaguauuuuucuaugucugcuuauuuuacacaacauuauacuuauguaguucauccacauuuugcauggagcuagacauuuauucucauugcuguauaauaaugcauugaauaaauaaaaccauuuguuuacacauuaugcuguaggugaucauuuggguuguuuucagauugaggcuauuaugaacacugcugcuauaaauauucuuguacaaaucuuuuauuuuuugcauguggacacaccugucccuacagauaagcuuuucauuugccucuccaaggacccuggcaauuucacugguccuguaccagucuuuguuccuuggcccagguuccuauaccaugugauagugaaaauucaccucccauuaaaggccaauauuuuauuuuguuuauguuguuuuuggcauaaaugauuuuuguccucacccugaauuuuggacagauuccuggcugccuggcauuuucuguguaguguuuucuagcccuguuuucauugcuaaggcagucuuuuaagguucuacauuuuuaugcauauaguucagcccugccacucucuuccauugggacugaaguaauauaucccauccucucaugggcuuuaaaccccauuucuuaucuuuuaggcauuucuuauaucuguaucugaaacuuuuuuggaucacugcagaguccaguuaaguuuguuccuccagcuuucauuucuuuuuucuuuucuggcuuauagagauuuaccuaccuuuuuuuccagacugaaauuaagcaacaugcuucuauuauauuuuauccaguauuucuguguuugugguagaaagauugcccucauauggaccagcucauguugcuucaagcccgugacuugugggucauaccauacugacuuucacuauuucauuccuuaaacuacugaacauauauuauuuccugccauuugacuauguauuuuccccuucuuuucaaaaaugccaugaaaaauugugaacucucucagaccuaagugaacuauguucacuugugcucauauugagaagcaacacaaacaauauaggucucuuauuuuacagguaagucccuuucuuguuucuaauaaagauauuuuauuuccuaauaaagauauuuuauuuccuuuaaaguggaauuuugucaucuaaaauuuuuguaagucacuaggcaaauaaaaugaucuaaucacauuuugauagugcuuuuauuuucacagaguauuuuuuauuaagaguaacacuuggggcugggcacgguggcucacgccuguaaucucagcacuucaggaggccgaggcaggaggaucacaaggucaggagaucgagaccauccuggcuaacacggugaaaccccaucucuacuaaaaauacaaaaaauuagccagacgugguggugggcgccuguaguuccagcuacucgggaggcugaggcaggggaauggcaugaauccaagaggcagagcuugcagugagcugagauggcuccaccgcacuccagccugagcgacggagcgagacuccgcucaaaaaaaaaaaaaaaaagaguaacacuuggaaauaaucuuguuagacuucacauuuaauuauggucuauuacuauaaaaaggugagaaauuacugaauaaaaagcauucuguaagaaaaaaaguuaaaaggugguaaaaaaucagaagcaagugacuauuuacuauauaugacaauaagugacauaugucuuauacuguugaguauaacuauauuuacaaauauaagcgaaacaauagguauaauuguauauacaccuaucuaaaaaauauuuaucaagcuguauuuuacacaagaguuaaaaguaucaaacugaguaguuccuacucuuauagaaccuaguagcuauagacacaaaguauacaauaggaauacauugaaugugcaguugguacacagaagaaaugucuaaagccuuuaugagagcagucagguaagaccagaugaggggagcaguuaagccaaggcuugaaagacgagugagauuuuguuaaguugauaaauuggaaggaagggaggaaagucauagaggcaugagagaguuuggggguaauccaaggauguuaguacucuggagcauaaagaacaugggaaagaguaugugauuagaaagaaaagacauaacaguuugaacucacccccugcuuuccccacccuaaaauagaucaguuuugcaaggagaaagaagcauagugcucuauuaagcuccccagguuucaacaggggcagaugaugcauauauuaagggagagagcuagauaguggcuccuaguggggugaacuccccuauuuaucauuaugccauguaaccuguuugugguggcuuauagcuuauaaguguuccuaaaugucuuauaacuccugguggugauaauguagguaaacagcaaagauggcagcaaauggaaugcucugagugguuuaauauagugacguguuuuacacuuguuguagaaucacaauguuauguuggacugaggagaagaaauaauacgcaauuugagccaucaaccuacgguuuaugagugagugaguggaucuagacagggauguguuucucaaaaccagaauauaaacugugggcuguugucugaagaaaaugguagcaacugauguuauguuagauuuucaucuuuuucuagauuuccaggaaaauguugugacagggcuaaugcacuugugccugaccuuucuucaccugcauauacagccagguaccugaaguagcgaguggcucccacugcauucauugcauucuugguggcucugaguccuggccaugcauuaugguucagaggcaaugccugggccccaugccaaauucccuuagucggcucuaguuggaacuggcuggcuacaacauuucuuuaagccaaaacauugcuugagaagauaaaccuuuaacuguacuccccauauuuuguuugcaugauaaugcaucuacuuugcaguuuugauggcucaucacuuaauguuaaagaugaugaaaaguuagagugaauugagcuuccagauuucuuuaagccauuccagccugucacaggcagucuacaaugauaugagucgugccaaccccucaaggucgugacuucaugccagugcccuuaauuauuaaaaauuauccuuccaacucaaacuuuaaauauuggacaucuaagucauuuuuucuuccaaacuuauaagaauugcauucuguuugguaacuauaauuuccuuauuuauacucauguuuaaauuuauacuuauguuuaaauuuauuugguacuuaucaucagucucuucauaccagacuuccuaccucauacauugucugcuauaacguaucuguuguugacuggauuacaucuuuuggaagagcauacuggggucuuauuucccaauuucaugcaaguuugagaauaucuuuaaguugccuuuaaaacugaauaacuugacuagauauagacuucuuggaccacaucuagaaaaaaucuaacuauauuugagauuuagaugugugauaaucauaauuauaauagacauuuguuaaguacuugcuaugugccagacuauucuaagcucuuacaugagcuuguguauuccuuagauccaauccaagguacuaauguuaucuucauuuuaauugccaaaugucaucuagcuacuaagugaugagauugacauucacacuuaaacaguaacuuucuauacuaccucucaagauaauuaaccuaaaauguuuuaacugugugaccuugagcauguuauuuaacuucuagaugccucaguuaacucuguauaaaaugagaauauuaauaccuccaaagguugcuuugaugaugaaaugaguuaauauaugucaauagcucauaacaaugccuggcacauaguaagugcuuaauaauugucuguuguucuuuuauuauuuuuauuuguggauaguaaguugcagaucugagcuuugaacaagcagucuggccucuguaacuuugcucuucgguacuacaauguagugucagcaauuaagauggcauuuuaauuuagugggggaaaacauggauuagucaguaaauaguguugggauauaguagauacucaauacuuguugaaugaaugagaguuuuauaaaaguauaaauacauuaacuuaaauauuaacaaauagauauuaaauaccauuuagauuuguauagacaguuuggaaauacuuuagucuguuccacugcaauaaaaaaauaccuuagacuggguaguuuauaaauacagaaauauuuucugaugguucuaaaggcugagaaguccaagaucaagguggcacagauuccaugucugguaaaagcuugcugucuucuuccaagauggcgccccuugcugcauccucacauggcagaaaggauaaaaaggaccaaauucacucccucaagcccuuuuaaaaggguacugauuccauccauggaggcagagaccccaccucuuaauauugucacauuggggauuaaguuucaauaugaauuuugaaggggacacaaacauucaaaccauagcaagaaggaagcaaaaaugagaauagaugcaugauuaucaaauuguagguuauuuucuguuuugaauuuccuuacguucuuauauaauuucucuaauaauacaauucaugauauaauuuguacagauaaccacuuaguuguauuuuguauauauugaguuugagguaccuagaaauaugacuggaaggucagagcucauauugagauuuugggaccaucagaagauaaugagacagacuacccacaaagugugugcaguggcacaccacauauaaggaauaagcaaaguaagaggaguugacaaagggaauuuaaaaggaagugcuggaaagacaggucaagagucagaaaagagaggccccaaaauaugaaucaaugggacagguggggaaagaaauuaccugaagcaaaugauucaggucaggaaagcauucacagcauuuaggaaugaaaaaauauuugaugauguuaagccauuuuauaagaauagugaauauacaagucaaauuaccacauaggaauaaaggaaguuagguagaaacagcaaauguagaugauguuuucgacaacuuugaggaccaaaaaaaggggaauguauucagggagaaucuagagugagcuaggguuccuuuuuuuggugcuggaacuuuuuuggauggaaaaauaaugagagagcaggacaucacuggacuggagagacuaaagacuuuaggagagaaaggaggaaauugauggagcaagacuugaaagcagauaggaaggaauuguuugaaggacaaaagcaaaaaccauugguaaggaggacucuuugagacacugaauaaggagaugauaucguaggccauuuuagaaauguaagugagacagaucagcagcaugccagcuucugguguuuagaucagaccuuuuuccugcguauuuaugaccaaggagcagacaguaggacagccucucuucaaacaauuacaucugcgugcucuauuucucgaagucuguuuucuguauagagaaaaccuuggugggcgugguggcucaugccuguaaucccagcacuuugggaggccaaggcgggcagaucaccugagguugggaguucgagaccagccugaccaacaugcagaaacccugucucuacuaaaaauacaaaauuacccaggcgugguggugcaugccuguaauuccagcuacucagaggcugaggcaggaaaguuccuugaacccaggagguggacguuguggugagccgagacugugccuuugcuuuccaggcugggcaacaagagcgaaacuccgucugaaagaaaaagaauagaaaaucuugcuauuuucuguucucucuucuugugagauaucaguauaggguagaaauagaugaucaacugauagacugacuuacacacaccuugcucucacagucacuccuauagccuaaauauauaacuugugguaaaaaaaaaaaaaauuagagucaaaucagaaaguaguaugcaguacacucugcuaaccuccuguaggacuggcacuaugugcacaaaagucagcaaagauaugaggcuucacaguuacccuuuauuaggugaaggcuuaauuccugggacucuaaacaagagaugaacacuaugugaguguacaugaacauaaguuuauagaggcaugcaucuuuaagaaaauauuugugcuuuuccagaaaugcaugaggucaggaaccuucuugauaucagcugucacauauauaggccuuuuggcauuuuugcccuuugccguuuaggcuaauccuuuccccugcuugauuaaguacauguuuuagguaccucugaguuccuuuacuaccaacuuuggccagaagacucugauuuuaaucuuaacuaauguaaaauacuacaggaaaaucccaugaucuuuuaaaauuaugugucaugcuucagcaguauaaguaggcugaaguaggcugaugauauuaaaagacucacagucuguuuuaaagaaauuuauugggaaaaaaagagagugucaaaaauaguaaauuaacguuuacauguuuaagcugaauuuuuuuauuuuuguuaaaucuaaauaaauuagauuguuccgugccuuauuaacauauuugugguuuaaaaaucauuauugaauauuaaauucaugugccagaccuuuuuaaaggcauccauaguuuccucuacacaaagugaccccagggugaugugcgauguguauugucuauacuucuauaaaguuucuccucuuuauugaguacuucuaucuguuuuaaguucuuccuuuaucauuauuucuguucaagguauuuucuaauguguagucaaaauaaggcagguauuaaauucaguacaauaagugaucuuuuuuacaugcucuuccauugauuccuuaaagagagaaccagcucugggauuuuuccaauagaacuaagcauuuagauuuuuuuuuaaaaggucuuuuccagaggccucuucaauucuuuagucuguaucuguuuucuugaaggcaucaaugucagaaagaaagguuuuacuagaguuugaccaccugguacaacuaaugcuuaucagaaacguguagcuaaucuugaaaugacaucuaaaggcaaucugauacugacaccauuaagaagauaaacagaaaucucuugcaaaagauuuuuaaaggagcccuaggauugauucuucagcuaugcucaccuaauuuaggcuccuaaaggcacagguaaaguacugagcaguuuuauagcuucaccaacauucagcugugccaggcaggaagcuggcugagucaugcacuugcugauguguaucuagucucuauuucaguugucacugcauagaauuuccagugaaucuuagauauuguaaauaauuuugacucauuuuguuuuuuuagggcagcacaacuacuuaugugcuggaagaaaugacugcaucguugauaaaauccgcagaaaaaacugcccagcaugucgccuuagaaagugcugucaggcuggcaugguccuuggagguaauucugauguuuucaucaauaauauacuguguaaucuuuauacuauaaaacugugugucagaaaauugcaauuucuuauucaucuuuguuuuuguuuuuucugucuugauuauuggcagugacucugcacaugugagugucugaaugaagcaaccaauaccauuccauuaacuuuacaguuuucuagcacauugaggucuguuaagagaagaaaacucaauucaucuauauugccuauaaguagagguaaugggcaauguacugaccugucauuaaguaacaugugugggagucuaggcuuugcugcccaucuccugugugaccacagcucuuccugggcaucagucuacuuaucuguaaaacgagagcauuaacauuccuuucagcucaaaaaauugacucugcaaauuggucagguacauugcuuacuagcuucuccaagugauugauuaaagcaagauuacuguaacugggguaggaauccauuugaugaagaguuauauuaauaauucccuuuucccauauuuuuauuagaaucucuaaaacuuucaguaauauagcacacauuuaaaaaauuaaugucagauagugacagauaguuugaaugaaaacauagcagagugagggagaucaagcgagccacaguuaugcaagacacccguacucccuugaauuuuuucacuuagccacauccugcacaacacugucugggaaucguagcuuuuacaucuagauauaacuuuuuaaaaacauaauaaaaauauuacauaauuguuaaagcuaaaaauguuuuuucagugcacuaacuauaaacagcuuguguuccauggacguuguguguauuuuccuuugggaaaugcuauauuuagaccaaugcuugucaaguuuaaagcguauacaacugucaccucauuuguuuuugcaaaugugcuggaccaaaauuaaucacccagguaacauacugggcacuuuacaguaauucauguaauuagaucacuuauagaauuuuauaauuucuugauuaaagauuuguuuuccuaaguuaagggcagugauuagguugacaguagugccuggcuuaaggaggugcucaguaacuuucuauuaaaugaauaaaaccacaaccucagcagauuaaaauuguuuuugagucccacaccucaauuaccaccucuuuguauuucuguuucaacucagaagucuuaaggaaccuccuaaauuuuagaaaauacaacuuuuucacaaaaucacacaucuagucaaugucggagccagaagaaagaccugaagguauucugacccuggcgcagccauuguuuucuccuuggcaugcuugccuuagaaaguagcagagcaucuaaugcugacacuuagauuccauuaagaucuuuaaucuugaguguuuucccaaugacuuuaaaagacucuucaauuuuaucaaagaaugaaaauggcggaguucuggauagaaccuucagaauacuccuggggaucagcaauauaaccuagagaaauuuauguuaucuuuuaauauucuagggcuuuauuuauuuauuuuugagacagagucucacucugucgcccaggcuggagugcaauggugcaaucuuggcucacugcaaccucugccucccagguuccagcgauucuccugccacaaccucccaaguagcugguaucauaggcacccgccauuacgcccagcuaauuuuuguauuuuaguagagaugggguuucaccauguuggccaggcugguuuugaacuccugaccucaggugaucugcccaccucggccuucuaaagugcugggauuacaggcgugagccacugcacccggccuuuagcauauuauucaagcaucuguaauccuuuaucuucucuaaccaaacugcuuguuacuuuagccuguuauuccuaugcuucccaagccauauucuacgggcuucacagcuauugcugcauuuucauaccuuuuauauuacuuauuuguuuaacucuacucccuccaucucucccuccuuuccgucccucccucccucccuuccuucuucuuuccuuccucccucuucucccucaaucgcuuucuaauuugcaccccaucccuuucuuucaguaacuguauaucgagcccuuucuaguuaccagauacuauucuaaguucugcgcauauagcagcaaagaaaauggacaaaauuccugcccucauagaucuuacacugugggaggacgagcaacaaauguacaugucaaauaaugauaagugcuguggaaagauauuaagcagaguuaguggggauuaucaggaagcagacucacuacuaaacucauuagucuaauauuuuuguuuugcuuagccucuuccuaagcaauaauaucucugaaauaauggauuugauaugccaguuauaauuuuucuaaaagacauuaauauacauucuuaacuauuuaaauauauauucgauguaccaccuaaaaacugcuuguauaccauaaaugauuauguguuaaacucugggaaagaguguauuagaccauuuuuuuccagcuaucgcagcucuauuuauuuuuucagcuuuuauuuuagcuucaguggguacaugugcagguuuguuaccuggguauauugugugacacuaauguuugagguacaaaugaucccaucaccuagguacugagguacugagcauaguacucaauaguuuuucaacccuuucuucuucuuccuuccuccucuaguaguccucaguuuccauuguuaugcucaugaauacccaaugucuagcucccacuuauaagugagaacaugcaguauuugguuuuuuguuccuguguuaauuugcuuagggucuuggccuacagcuacauccaugcugcugcaaaggaugugacuucguucuuuucauggcugcauaauauuccaugguguauauaugccacauuuucuuuguccaauccacuauuaaugggugccucaguuaauuccaugucuuugcuuuugugaguagugcugugaugaacaugugagugcaugugucuuucuaguagaacaauuuauuuucuuuuggcuauauauccaguaaugggauugcuggucuaaugguaguucuguuuuaaguucuuugagggccgggagcgguggcucaugccuguaaucccagcacuuugggaggccaacgcagguggaucaugaguucaggagauggagaccauccuggcuaacacagugaaaccccgucucuacuaaaaacacaaaaaaauuagccaggcaugguggcaggcgccuguagucccaccuacuugggaggcugaggcaggagaauggcaugaaccugggaggcggagcuugcagugagcugaguucgcgccacugcacuccagccugggcgacagagcgagacugucucaaaagaaaaaaaaaugucuuuugagaaguguucaaaccaauuucuaccguggcagaacuaauuuacauucccaccaacaguauauaaguauucccuuuuuuccacagccucaccagcaucuauuagguuuugaguuuuuugaguuuucuuuuuugagacagagucucacucugucacccagacuggagugcuguggcacaauuauggcucacugcagccucaaucuccugggcucaagugaucuuccuaccucagcauccugaguagcugagacuacaggcacgcaccaccacaccuggcaaacuuuuuauuuauuuuuuuuuuguaacgauaaggucucacuuuguuacccagucaggucucaaacuucugggcucaagugauccucccaaagugcuggaauuacaggugugagccaccaugccuggcaugaguuuuuaauaauagucauucugauugguguaagaugguaugucauugucgcuuugauuugcauaucuuaaugauuagugauauggagcauuuuaaauguuuguuggcugcuuguaugucuccuuuugagaaaugucuguucaagucuuuugcccauuuuuuuggugagauuuuuuuuuuuugcuuguucaacuguuuaaguuccuuauagauucuggauauuagacauuuguuggaggcauaguuugugaacauguucuccuauucuguugguugucuguuaacuccauugguaguuuauuuugcugugcagaaacucuuuaguugaauuaggucucacuuguuaauuuuuguuuuuguuucaauugcuuuugagaacuuaguuagaaauuauuucccaaggcugauauccagaaucauauuuccuagauuuucuuuuaggauuccuaugguuugagguguuauauuuaaaucuuuaaucuaccuugagguaauuuuuguauauggugaaauguagggguccaauuucauuauucugcaugugacuagguagguaucccagcaccauuuauugaauaaggaauccuuucugcauugcuuauuuuugucaacauugucaaagaucagauggcuguaggugugcaccuuuauuucuggguucuauauucuguuccauuggucuaugugucugcucucgugccaguaucaugcuguuuugguuacuguagccuuacaguauaguuuggaauuggguaaugugaugccucugacuuuucuuuuuguuuaggacugcuguaguuauuugggcucuuuugauuuuauauaaauuuuagaauagcuuuuucuaguucuggaaaaaaugucguugguaguuugauaggaauaacauugaaucuguaaauugcuuuggacaguauggccauuuuaacaauacugauucuucuaauccaugaacauggaauguuuuuacauguguuagugucaucugugauuucuuuuagcaauguuauguaguuauccauguagaaaucuuucaucugcuuaguuauauguauaccuagguauuuuguguguguguguggcuauuuuaaaugggauuacuuucuugauuuggcucucaccuugaaugcuauaguuguauagaaaugguacuaauuuuuacauguucauuuuguguccugaaacuuuacugaagucauuuaucaguuuuaggagccuuuugguggagucuuuaggguuuucuaguuauaaaaucauguaauaugcaagagagauaguuugacuucuuuuuuucauguuugaaugccuuuuauuuccuucucuugccugacugcucuggcuagcacuuccaguguuaacaggaguggugagagugagcauccuuaacuuuuuccagaucucaaggaaaauucuuccagcuuuugcccauucagucugauauugguugugaguuugucauuuuggucucuuauuguuuuuagguauauuucuuuguugccuaguuucuugaggguuuuuaucaugaagugguauugcauuuuaucgaaagcuguuucugugucuauugagaugaucauaugguuuuauuuuuaauucuucucaugugguaaaucauauuuauugauuugcauauauugagcuaaccuuccauaccaggagugaagccaacuugaucgugguaaauuaacuuugauguuugauuugguuugcuaguguuuuguugagaauuuuugugucuguguuuaucagagauauuguccuauaguuuuccuuucucaugguaucucuuacagguuuugguaucagggugauacuggcuucagaaaacgaguuagggaggagucuuuccuucucgauuuuuugaaauaguuucaguagaauugguaccagcucuacuuugugcaucugguagaauuuagcugugaaucucucuggccagggcuuucuuuuugguugguaaguuuuuuauuacuaauuccauuuggaacccaauauuggucuguucagugcuuuaguuuuuuccugauuuaaacuugggacauuguguguuuucaggaauuuauucauuuccucuagauauuguaguuuguguguguagagguguucacaauaguuaucuaaggaucuuucauauuucugugggaucaguugugaugucaccuuugucauuucuguuuguguuuauuuggaucuucucucuuuuuuucuuuguuaauguagcuagcagucuaucaaucuuauuuauccuuuaaaaaaauaacuuuugguuuuguugauucuuuguauagauuuuugggucucaauuucauuugguucugcucuuuaguucguccuuuucuucugcuagcuuuagggauaguuuguucuuguuuuuuuuuuuuuuuuuuuuuuuuuaguuccucuaggugugauguuaggucauuaauuugagaucuuucuaacuuuuugagguaggcauuuagagcuguaaacucuccucuuaauauuguuuuugcuacauuccagagauuuugguauguugugucuguuuucauuuauuuuaauuuuuuuuuauuucugccuugauuuuauuguuuacucaaaguuauccagagcaaacuuuuuaauuuccauguaauugugugguuuguacagaucuucuugauguugguuucucuuuguauuccacugugaccugacaguaugacuggcaugauuuugacuuuuuaaaauguacugagucuugguuuauggccaaggauguggugaaucuuggaguauauguucuguguacagaugagaagaauuuacguucugugguugauggguggauuauucuguagauguuuauuagauccaauuggacaagcauugaguuuaaguccagaauuucuuuguuagucuucugccuugaugaucuaaugcuaucagucccccacuauuguuguguggcuuucuagguccuuagaaguccuuguuuuaugaaucugggugugccaguguugagggcguauguauuuaggauaguuaaaucuucuuauugaacucuuuaucguuaugcccuuauuuuuccuuuuuuacuguuguuaaagucuguuuuaucuaaucuaagaauagcaaccccugcucuuuuuuguuuucuguuugcaugcuacaucuuucuccaacccuuuacuuugagccuaugguugucauuacaugugagauggguuucuugaauacagaagauggaugagucugguuuuccuagcugguuugccacucugugacuuuuuuuuuuuuuuagauggagucuuacucugaugcccaggcuggagugcaguggcgcaaucucagcucacugcaaccuccaccucccagguucaagcaauucuccugucucagccuccggaguagcugggauuauaugcaccugccaccacggcuggcuaauuuuuguauuuuuaguagagaugggguuuuaccuuguuggucaggcuggucuugaacuccuggucucaggugauccacccgccucagccucccaaaguucugggauuacaggugugagccacugugccuggacccacucugugacuuuuaaaugggacauuguauuaguccauucuugugcugcuauaaaguacuaccugagacuggguaauuuaugaagaaaugacauuuaaaugacucauaguucuacaagcuuaacaggaagcauagcuaggcaacgucaggaaacuuacaaucaaggcagaaggugaaggggaagcaagaauaucuuaccauggcagaguaggagaggugggucaggggagugccacacacuuuuaaaucauuauaucuugggagaacccacucacuaucaugacaacagcaugggggaaauuugccuccaugauccaauaaccuccuaccagguuccucccucaacauugggaauuacaauucaacgugagauuuggauggggauacagagccaaaccauaucauucugccccuggccccucccaaagcuuauguccuucucaguuuucaaaacacaaucaugccuucccaacagucccccaaagucuuaacucauuccagcauuaacccaaaaguccaagaccaaagucucgucugagacaaggcaagucccuuccaccuaugaucuuguaauaucaaaaacaaguuaguuacuuccaagauacaauagggguaugggcauuggguaaauacucccauuuuaaaugggaguaacuggccaaaacaaaggagauacaggccccaagcaaguucaaaacccagcagggcagucauuaaauauuaaagcuccaaaauaaucucuuuugucuccaugccucacauccagagcauacugaugcaagggaugggcucccaaggccuucagcagcuccacccuguggcucuacaggauacagcccccacagcugcuuuuacaggcuggcauugaaugccugcagguauuccaggcacacaaugcaagcuguugauggaucuacgauucugaggucugguugauggugguccucuucucacagcuccacuaggcagugccccagugggaacucugugcaggggcuccaaccccacauuucccuuucacacuguccuaguagagguucuccaugaggucucugcgcuugaagcagacuucugccuggacauccaggcauuuccauacauccucugaaaucuagguggagguuuccaaaccucaacucuugccuucuucauacccgcaggcccaauaccauguggaagccaccagggcuuuggguuugcauccucugaagcccuggcccaagcuguaccuuggccccuuuuagcaacagcuggagcuggagcagcuggaaugcagggcaccaugucccaaggcugcacagaguagcuaggcccugggccuggcccucaaaaccauuaaucccucuuaggcuucugugccugugaugggaggggcugcugugaaggucucugaaaugcccuggagacauuuuccccauugucuugacuguuaacauuugacuccucuuuacuaaugcaaauuucugcagcaggcuugaauugcuccccaggaaauguuuuuuugucucucucuuuucuaccacauggccaggcuacaaauauuccaauauauuuuuugcuuugcuucacuuuuaaauguaaguuccagguucagauaaucucuuuuuucaugcauaugagcauacauguuuagaaacagccaggucacauacaucuggaaugcuuuguugcuuagaaauuuuuuccaccagauaccccaaaucaucucucucaaguucaaagcuucacagaucucuaggacaggggcaaaaugccaccagucuuuuugcuaaagcauagcaagagugaccuuuacuccaguucccaauaaguuccucacuccaucugagaccaccuaagccuagacucauuguccaugucacuaucagcauuuuggucacaaccauucaacaagucuccaggaaguuccaaacauucccauaucuuucugucuucugagcccugcaaacuguuccaaccucugcccauuacucaguuccaaagucacucccacauuuucagguaucuucuuaacugugcuccacucucccaguaccaauuuucuguauuagcucauucucauacuguuauaaagaacuaccugagacuggguaauuuaugaagaaaagaacuuuaacugacucacaguucugcaggcuuaacaggaagcauagcuaggaggucucaggaaacuuacaaucaugguggaaggcaaaugggaagcaagcacgucuuaccagggcagagcagcagagagagagagagagagugagaggggaagugccaccacuuuuaaaccaucauaucuccugagagcucacucauuaucacaacaacaguaugggggaaaugugcccccaugauccaaucaccucccaucaggucccuccccaaacauuaagaauuaaaauucaacgugagauuugggugaggacacagaaccaaaccauaucaggcauuuagaccauuuacguucaagguuaauuuuuauaugugagguuuugaucccuuguuuaguuguuagcuguuugcuuuguuguuucuauuguguuuuugcuuuguagggugugcaggcuaugugcuuaaguguguuuauguggaagcagguaugguucuuuugcuuccauguuuagaacucccauguaaggaucucuuguaaggauggucuagugguaacaaauuccuuuagcacuugauugccuggaaaagauuuuauuuguccugcacuuaugaagcauaguuuggcaggaugugaaauucuugguugaaauuucuuuuaagaacgcugaaaacaggcccccaaucucuccuagcuugcaaaccucugcugagaaaucuguuauuauccugauagaguucccuuuuuaugugaucugcacuuuucucuggcugccuuuaagauuuuuucuguaauauugccuuugaacauucuggugacuauauaccuuggugauuuuuuuuuuuuugagauggagccuuacugugucacacaggcuggagugcaguggugagaucuuggcucacugcaaccuccgcccuccaaguuccauggauucuccugccucaaccucccgaguagcugggauuacaggugccugccaccgugucuggcuaauuuuuuguauuuuuaguagagucaggguuucaccgucuuggccaggcuggucuugaacuccucaccucaugauccaccugccucagccucccaaagugcugggauuacagacaugagucaccacgcccagccagugauguucauguuuguggugucucacagauguucucuggauuucuagcucucuagcaagauuaggaaaguuuucuugaauuauucccucaacuauauuuuccaguuuguuuucuuuuucuccuacuuucugaggaaugccaauaauucauaggguuuuuuugcuuuauauaaucuuauauuucucaaaaacagcucauuuaaaauaauuuuuuucuuuauuuuuaucagauuggguuaguucacaagaccagccuucaagcuuuaaaauuuuuucuucugcuugauccagucuauugauaacgaauuucaaaauauaauugaaggcuuuaagugaguuuuucaauuccagaagcuacuauugauuuuuuuuaagauguucaugucuuucuuaauuuccuagauugcuuuagaaguuuauguugguuuucaaccuugucuuugauuacaaugaacuuccuugcaauccaugcuuugaauuauuuaugugucauuucugaguuuccaucuugguuagggaccauugcuggaaagcuagugcaaucccuuagugaugucacugcaaucagauuuuucauuaugccagaauucuugcacugguuucuucucaucuggagacauuggcacuucaaauuuuuguacuuauuuucauguggguaguaguuuuucuuuuuuuuuucuuucccuauaaugguauuauuauuauuauuuuaauaauuuuuuuuguuucccuuuuaccccuuuucuagggcuugugccucuaaagaaugcuggguaggaucuuuucacuuugauucuacagcccuaugugcuucuuucagcagguuuuauacugggcucugcaggucaucccacaggcccauaggcggcacguauagguaagagcuggcugugaccaauguggcuggauauauacuugauccuuguuuccgagcaaaagcucuccauugucuuaggcaauaggcugauucugauucauagaaugcacaguaguuggaacucccugcucagccccaaggagaagggaaccacaaagggcaaguuuggaccgagcagguccaccugcguccccugauggcaagcacaagcaccagugccaaggaagaauccaguggguggccaccaagcacccagaguuguacacagaccugaagcuuggaaaccuccucagcugcaaauucucugcaugggaggcauccuaagcuccugauucaggagagugggugcuccagaugccuggagaucugcuuuggcauggaauagagaggggcccccugcaccaagaucucuacacaggagggguaaaugacaauuauauauagugcugcaggaaacaugugaaugcagauaauaucuucaauauaccaguuuucuuucuuuuggcuauaugcccaacaguaggauugcugcaucacgugguaguucuguuuuuaguuuuaggaaccuccauacuguuuuccauaguuacaguacuaauuuagauuacuaccaacaguguacgagaauuucucuuucuccauauccucaccagcauuuauuuuuugucuuuuuaguaacagccauuuuaacuggagugagauaauaucuuauugugguuuuauuugcauuucccugaugauuagugauguugagcauuuuuucauauaucuguuggcauuuguaugucuucuuucaagaaauuucuguucauuuugccuauuuuuaaaugggauuacuuuuuuuuuuugcuauugagcugaguuccuuauauauucugauaauuaacuccuugucagaugaauaguuuucaaauauuuucucucauucuuugucucuucacauuguuaacuauuuccuuugcugugcggaagcuuuuuagcuugaugaaauuccauuugucaauuuuugccuugauugccuaugccuugaggucuuacuacaaaaauauuuacccaaaagucuuaaagcaguuccccaaaguuuucuuguaguaguuuuguaguuucagaucuuacacuuaagucuuuaaucgauuuugauuuuauuuucguauguggugagugauagugaucuaguucuguuuucugcauauagguagccaguuuucccagcagcauuuauugaagagauugcccuuuccccaauguauauccauggcaccuuugucaaaaaugaguugacuguuaaugcauggcuuuauuucuggguucucuauucuguuccauuggucuuugugucuguuuuuauaccaauaucaugcuguuaugguuaagaauucucauuucugacauagagaccauuuaaauaacaaaagauaaaacaugagagaauauuagaaagcuuuuaaaagauuuaauaaaaucuuacaguagaauaauagagguaauaaauauguuuugacaugucaugacauagauuuuguuaggagcaguuuguucuuaucugcuuccguggcuauguuuugauuauaaaaauuauguuuugaguuauuugauuucuucguugcauaugauucuugucuuuaaugaaucacuucccuaccuugaacaggucacagugaacuuuugcuuuaguucacugcuguacagcacugagugggaagauaguuacacccuuaaggaugauaauauaucuucuacuuuagguguucugcuuccaucuucuuucuucuagaaaacauuuuuguuuaaugacucacaaaaaaauaucugaaaugaauacagcuuuauauuuugcaguuguaaaaaugcuaaacuaguauaagguaauuagcucuuucaaaaauaagucgcuuucuacauaaaagaaugauuaaaugaauaguuaucuucuuugaaauuuuuuaaauccacaguuacagguuuuauggguuuuucuuuuuuucuauuauuuucuuuuuugguagcaagccuuaucuucacauuuuaaaagguuguguuagaaagccaguuucucuccuucucccccuaccuccuccuccaccuagauucaaccacuucuuauggcaaagagaauaacuuucugggcuagagaguauggguuguguaguaaagauuuuuguuguuuuuuuguuuucuccuccuacacuugacagccaacaaggcuacaagucuucuuuggaagaacugcaaaauucuugaauuuaggacacagugguaucuuuucuagaaguacagaguccugcucugugccuuuaauacccuaagaacaaaaaucauuuuuccucuuuaaggcaagaucuacugugggugauggcuaccaccuaccucucuagaccucacagaaucuucuucuuaaugggcaucucuuuuuccacccaaauccuggccuuugaaucagcaucucucagagacagcaccucucacauugcuccccaaguucacugcauuggagccugcagccaacugauguccuucucaucagucugguuguuuacccuaaacaccaucucacacaugcuagcuggggaugguccucagacuauucauucucauuucuuugcuuaaaauuuuucuguguuuguaugggaugucuuuuaugguuugccaacuagaacuuuucaguaguaucuacaagcauuuauuauuuucuagacucaguaaaaaguuagaauugagggguucaaauaucuccuccauuguaguugacuuuauuugaaugauuaagacauauacauuuaaaaaaaucaauucuaguauaguuuugguuuuuggaaaauaccugauuucacuuuauauuuccuguugucuagcaucuuuguuuucuuugaaguauauacaaaggcacacuguguuuugaucuggaaauuggaggugaauccugaaaaauggaaggcaagcacuaucagugcuauaaaggauuguuaaaguguagugccaguggacugaucccagcacugcgcaguggucauuaucauuuugguaaucugaaguagaagcaugccucuagacauccuuccauaauuuuauauagguaguguaaggaugacugucuauaaauucaccugaacuacagagagacuucugauauaauaaaagaaaaauacagagauuguucaggaugggaauacaaacacuaggaaacuggaaaagcaaauuaaaacuucugaauuaauagaaaaaguuaaauaggaaagagaaaauaaagggaaacuugaccaagguagcaaagaaagaaaauggaaaagagguaauuaugaggcaguauaaaacaaacucugucgcaaaaaaaaaaaaaaaaaaaaaaaaaauuccauuuguaguuuuaaaaaaauaguaaagauauagaaaaauuaguagaaaauacaaaaaucuguauucuucuuuuaucagaauuaaauaauuaugccugcccuauuuuaccaaauuauuuuauuaaaacaugcuaaagaaguuuauaagcuuuucuucucccugcucccauucucuauaggauuuuugcugagauauuucaaaauuuuuauuuuuagguuauauuuaagcuuucacuucuaaucucucucaaaaaccuuucauaucacuugucauaaaaauuucuucucauaguaucaucauccagauucagucacauauacaucaagaauaauugugcaauacuguuuccuagacucuucaucuuaucuuuucaaugcaugauauuuaaauaagccauacuuuuuaauguuuucaauuuuuuaauuuauauuuauuuauuucaaauuuuuuauuauauuuuaaguucugggauacacgugcagaacgugaagguuuguuacauagguauacacgugccaugauguuuugcugcacccaucaacccaucaucuacauuagguauuucuucuaauguuaucccucccuuagccccccaccccccgacagaucccugugugugacauuccccucccuguguccauguguucucauuguucaccucccacuuaugagagaacaugcaguguuugguuuucuguucuuguguuaguuugcucugaaugaugguuuccagcuucauccaugucccugcaaaggacaugaacucaucccuuuugauagcucaauguuauugcaugguguauaugugccacauuuucuuuauccagucuaucauugaugggcauuuggguuggcuccaaaucuuuacuauugugaauagugcugcaguaaacauacgugugcaugugucuuuaugguacaaugauuuauaauccuuuggguacauacccaguaacgggauugcugggucaaaugguauuucugguucuagauccuugaggaaucaccacacugucuucuacaaugguugaacuaauuuacacugccaccaacagcguaaaagcuuuccuauuucuccacaucuuuuccggcaucuauuguuuccugaguuuuuaauggucaucauucuaacuggcaugaaauggcaucucauugugguauugauuugcauuucgaccagugaugaugagcuuuuuuuucauguuuauugcccacauaaaugucuucuuuugagaagugucuguucauauccuuugcccacuuuuugaugggguuguuuuuuguuuuuuuuuuuguaaauuuguuuaaauucuuuguagcuucuugauaguaguccuuuguuagauggauaaauugcagaaauuuucucccauucuguagguugccuguucacucugaugauaguuucuuuugcugugcagaaggucuuuaguuuaauuagaucccauuugucaauuuugucuuuuguugccauugcuuuugguguuuuagucaugaagucuuugcccaugccuauguccugaaugauauugcccagguuuuccucuaggguuuuuaugguuuucagucuuacauuuaagucuuugaucuaucuugaguuaauuuuuguauaagguguaaggaagggguccacuuucaauuuucuguauauggcuagccaguuuccccaacaccauuuauuaaauagggaauccuuuccccauugcuuuuuuggucagauuugucaaagaucagaugguagauguguggcauuauuucugaggccucuguucugcuucauuggucuauauaucuguuuugguaccaguaccaugcuguuuuggcuacuguagccuuguaguauaguuugaagucagcuagccugaugccuccagcuuuguucuuuuugcuuaggauugucuugguuauaugggcucuuuuuugguuccauaggaaauuuaaaguaguuuuuucuaauucuaugaagaaagucaauguuagcuuguuggggauagcauugaaucuauaaauuacuuuggucaguauggccauuuucaugauauugauucuucugauccaugagcauagaguguuuuuccauuuguguccucucugauuuccuugagcguugauuuguaguucuccuugaagggguccuucacauuucucgugacuuguauuccuagcuauuuuacuccuuuuguagcaauugugaaugggaguucagucauguuugggcucucuguuugucuauuauugguguauaggaaugccugugauuuuugcacauuuauuuuguauccugagacuucacugaaguugcuuaucagcuuaaggagauuuugggcugagaugauggaguuuucuaaauauacaaucauguccucuacaaaaagacacaguuugacuuccucucuuccuauuugaauacgcuuuauuucuuucucuugccugauugcccuggccagaacuuccacuacuauguuuaauagcaguggugggaaaggacaucccugucuugugcugguuuucaaagggaaugcuuucagcuuuugccuauucauuaugauauucgcuguggguuugccauaaauagcucuuauuauuuugagauacgguccaucaauaccuagcuuauugagaguuuuuagcaugaagggguguugaauuuuguuaaaggccuuuucugcaucuauugagauaaucaugugguuuuugucauugguucuguuuaugugauggauuacguuuauuaaugugcguauguugauccaggcuuucaucucagggaugaaacugaccugaucaugguggauaagcuuuuugaugugcugcuggauuuggauugccaguauuuuauugaggauuuuugcaucaauauucaucagggauauuggccugaaauuuucuuuuuuguuguuucucugccggguuuuggugucaggaugauaccaaauaaaaugaguuagggaggauucccucuuuuucuauuguuuggaauaguuuuagaaagaauggugccagcuccuccuuguaucucugguagaauucagcuaugaaucugucugguccugggguuuuuuugguugguaggcuauuaauuacugccucaauuucagaacuuguuauuggucuauucaggaauucaacuucuuccugguuucaucuugggaggguguauguguccaggaauguaugcauuucuucuagauuuucuaguuuauuuucauagagguguuuauaguauucucugaugguaguuuguauuucugugggaucacuggugauauccccuuuaucauuuuuuauugugucuacuugauucuucucucccuucuuuauuagucuggcuaguggucuaucuacuuuguuaaucuuuucaaaaaaccagcuccuggauucauugauuuuuuuuuuuuaaggguuuuucaugucucuaucuccuucgguucugcucuggucuuaguuauuucuuguccucugcuagcuuuugaauuuguuugcucuugcuucgcuaguucuuuuaauugugauauuagcgugucaauuuuagaucauucccacuuucuccuguggacauuuagugcuauaaauuucccucuaaacaaacacugcuuuagcugugucccagagauucugguauguugugucuuuguucucauugguuucaaauaacuuauuuauuucugccuuaauuucauuauuuaugcaguaaucauucaggagcagguuguucaguuuccauguaguugugcaguuuugagugaguuucuuaauccugaguucuaauuugauugcacuguggucugagaaacuguuuguuauuauuuccauucuuucacauuugcugaggaguguuuuacuuccaauuauguggucaauuuuagaauaagugcaauguggugcugagaagaagguauauucuguugauuugggguagagaguucuguagaugucucuuagguccacuugguccagagccugaguucaaguccuggauauccuuauuaauuuucugucuuguugaucugucuaauauugacaguaggguguuaaaagucucccccauuaaugugugggugucuaagucucuucauaggccucuaagaacuugcuuuaugaaucugaaugcuccuguauugaguacguauuuuuaggauagucagcucuucuuguugcauugaucccuuuaccauuauguaauggccuucuuugucuuuugaucuuuguugguuuaaagucuguuuuaucagagacuaggauugcaaccccugccuuuuuuagcuuuccauuugcuugguaaauauuccuccaucccuuuauuuugagcauauugugucucugccugugagaugggucuccugaauauagcacaccaaugggucuugacucuuuauccaguuugcuggucugugucuuuuaauuggggcauuuagcccauuuacauuuaaggguaauaguauuaugugugaauuugauccugucauuaugaugcuagcugguuauuuugcccauuaguugaugcaguuucuuccuagcaucgauggucuuuacaauuuggcauguuuuugcaguggcugguaccgguuguuccuuuccauguuuagugcuuccuucaggagcucuuguaaggcaggccucguggugacaaaaucucucagcuuuugcuugucuguaaaggaguuuauuucuccuuugcuuaugaagcuuaguuuggcuggauaugaaauucuggguugaaaauucuuuucuuuagaaauguugaauauuggccuccacucucuucuggcauguaggguuucagcagagagaucugcuguuagucugaugggcuucccuuuguggguaacccgacuuucucuuuggcugcccuuaacguuuuuuccuucauuucaaucuuggugaaucugacaguuaugugucuugggguugcucuucucgaggaguaucuuugugguguucucuguauuuccugaauuugaauguuggccugucuugcuagguuggggaaguucuccuggauacuaucccgaagaguguuuuccaacuugguuccauucuccccgucacuuucagguacaccaaucaaacguaaguuuggucuuuucacauagucccauauuucuuggaggcuuuguuuguuccuuuucauucuuuauucucuaaucuuguauucaugcuuuauuucauucaguugaucuucaaucucugauauccuuucuucugcuugauaaauuuggcugcugauauuuguguaugcuucacacaguucuugugcuguguuuuucagcuccaucaggucauuuauguucuucucuaaaaugguuauucuagguagcaauuccucuaaccuuuuuucaagguucuuagcuuccuugcauuggguuagaacaugcuccauuaacucagaggaguuugucauuacccgccuccugaagccuacuucugucaauuugucaaacucauucuccguccaguuuuauucccuugcuggugaggaguugugaucuuuuggaggagaagaggcauucugauuuuuggaauuuucagccuuuuugcacugguuuuuccucaucuucauggauuuaucuaccuuuggucuuugauguuggugaccuucagaugggguuuuuguguggacauccuuuuuguugauguugaugcuauuccuuucuguuuguuaguuuuccuucuaacagucaggccccucugcugcaggucugcuggaguuugcuggagguccacuccagacccuguuugccuggguaucacuagcggacucugcaguacagcaaagauugcugccuguuccuuccucuggaaucuucaucccagcagggcacccaccagauugccagccagagcucuccugugugaggugucugucgaccccugcugggagguaucucccagucaggaggcacaggggucagggacccacuugaggaggcaguuuguccuuuagcagagcuugagcacugcgcugggagauccgcuggucucuucagagccagcaggcaggaacguuuaagucugcugaagcugcgcccacagccaccccuucccccagguucucugucccagggagaugggaguuuuauguauaagccccugacuggggcugcugccuuucuuucagagaugcccugcccagagaggagucuagagaggcagucuggcuacagcagcuuugccaugcugcagugggcucugcccaguuugaaguuccaggugguuuugcuuacacugugaggggaaaacugccuacucaagccucaguaaugguggacgccccucccaccaccaugcuccagcgucccaggucgacuucacacugcugugcuggcagcgagaauuucaagccagugaaucucaacuuacugggcucuguggggaugguaucugcugagcuagaucacuuggcucccuggcuucagccccccuuccaggggagugaaugguucugucucacuggcauuccaggugccacugggguaugaaaaaaaacuccugcagcuaguucauugucugcccaaauggcugcccaguuuugugcuugaaacccagggcccuggugauuuaggcacccaagggaaucuccuggucuguggguugcaaagaccauggggaaagcauaguaucugggccggaacacauuguuccuuacagcacagucacucacggcuucccuuggcuaagggagggaguuuccccacucuuuguacuucccggguaaggcaaugccccacccugcuucagcucgcucuccaugggcuguagcuacugucuagccagucccaaugagaugagguggguaccucaguugaaaaugcagaaaucacccaccuucuguguugaucgcguugggagcuacagaccggagcuauuccuauucagccaucuugccagccagcaaccacucuacuuuuuuuuuuuuuaauuuaaguucugggauacauguacagaauaugcagguuuguuacauagauauacaugugccauggugguuugcugcacccaacaauccaucaucuacauuagauguuucuacuagugcuaucccuccccuagcuccccaccccucaacaggcccuggugugugauguuccucucccuguguccauguguucucauuguucaccucccacuuaugagagaauaugcaguguuugguuuucuguucuuguguuaauuuacuaagaaugguuuccagcuucauccaugucccugcaaaagacaugaacucaucccuuuugauggcugcauaguauuccaugguguauaugugccacauuuucuuuauccagucucucacugaugaggauuuggguuggcuccaagucuuugcuauugugaauacugcugcaguaaacauacaugugcaugugucuuaugguacaaugauuuauaauccuuuggguauauacccaguaaugggauuacugggucaaauggcauuucugguucuagaucuuugaggaaucaucacacugucuucuacagugguugaacuaauuuacacucccaccaacaguguaaaagcuuuccuauuucuccacauccucuccagcaucuguuguuuccugacuuuuuaaugaucgccauucuaacuggugugagaugguaucucauugugguuuugauuugcauuucucucaugaccagugaagaugagcuuuuuuccauguuuuuuggccacauaaaugucuucuuuugagaagugucuauucauacccuucacccacuuuuugauguuuuuuuuuucuuguaaauuuguuuaaguucccuguagacucuggauauuagcccuuugucagauggauaaauugcagagauuuucucccauucuauagguugccuguucacuccgaugauaguuucuuuugcugugcagaaggucuuuaguuuaauuagaucccauuugucaauuuugucuuuuguugccauugcuuuugguguuuuagucaugaagucuuugcccaugccuauguccugaaugguauugccuagguuuucuuccaagguuuuuaugguuuuaggucuuauguuuaagucuuuaguccaucuugaguuaauuuuuguauuagguguagggaagggguccacuuucaguuuucugcauauggcuagccaguuuccccaacaccauuuauuaaauagggaauccuuuccccauuguuuuuuuuggucagguuugucaaagaucagaugguuguagauuugugacguuacuucugaggccucuguucuguucuauuguucuauauaucuguuuggguaccaguaccaugcuguuuuaguuacuguagaguugaaguauaguuugaagucagguagcaugauaccuccagcuuuguucuuuugacuuaggaugucuuggcuauacaggcucuuuuuugguuccauaugaaauuuaaaguaauuuuuuucuaauuuugugaagaaagucaauguuagcuugauggagcuauuauuggaucuauaaauuacuuuggucacuauggccauuuucaaaauauacauucuuccuaucuaugaauauggaauguuuuuccauuuguuugugcccugauuuccuugagcaguguuuuguaguucuccuugaagaggcccuucacaucccuuguaaguuguauuccugggcauuuaauucucuuuguagcaauugugaaugggaguucacucaugauuuggcucucuguuugucuauuauugguguauaggaaugacugugauuuuugcacauugauuuuguauccuaagaauaagccauacuuuuuaauauauuuuauucauaaaaaaaugcacauaaagcaaaugacauauagaaacaauaugauuaacauccaccucuggacucaguuggcuuaagaaaauaugaauauuaucacuacacuugaaauugauugcauauuucuuccuuaucacauuccucuuuaucuuucuccagaaaccucuauaucuuuaauuuggaguuggucauuuucuuauauuauucuguaggauuuuuuaauaucuauguauuucucacuaauagauuuuuuaguuuugagauguuuuuuucuacuccauagaaaugcuauguauauuuaugcaauuugaucuuacugccuaauauuauauuuguguuuuuuauuuugauuuguauuauucugguuuguuuuuuccuacacuguaugauuucauuguaugaguaucucccauuuauuuauucucauguauugacauguacuuccacuugauauuugcugugcuuuaccuacaguucaauugugaacauuauuuuacauguauucuggugguucaugugugagaguuucuguagguaaccugcacaccugggcaugaaauuucugacuguaauacaugcucaugcugggcuuuacuagauaaugcuagauuguuuuuaaaguaguaguaguuuacacuccauggcagcucuucauuguuuuguguguuccuguauucuguguccuugccguuuuagguagaugaugucucauguggucuuacuuugcauuucucugguuaauaaugaggucagucauauuguuguauuuugucaucuauauauuucuuccucugugaaauaucuguucaugccuuuucuuucugauuuauaggaauucuuuguguauuuuggguauauauguuauaaauaucuauaggauagauaaaaacaagcuaucugauaaggcgauaugcagaaauauaaauuaggugaggaagcaagccaugcaaauauccaaggaaaaaaucauuucaugcagaggaacuugucaguguaagaccccaaggcagaaacacacuucaagggcaagaugggcaucaauauggguggagcaugagggagaauagaagagagaccaucuaugcaaggguaaguugggccuuguagagcuugauaugaauuuuaacuucauucuaaguaggaucaggagucacugaaaauaucaagcaagaaugacauagucugauuaagucuuuaaaguuguauagaaaauagucuacaaaaagugaaagcugggaaaccagccagcauauguuacaauaguccaacugugauuguggggacauaaauuauggugcaagcaguggaaacagguauuuggauuuggguuauauuuucaugguuauccacuaggauuugcugauguauuagauaugaggugagaaaauaagugagguaucaguaaugacucuagaguuuggggcuagagcagcagguguguaaaugaaguuacaaaccuagaagaugcauguuuggaccaaugcaucaaaguucugcucuaaacauauuaauuugaggggucuguuagaaauacaaguggagaugcugagaauacaguugcauaguugagucuagaguuucuuggaaaagcugggucuaggacuguaaauuugguaaucauuaaugucuagaugauauuagagacauagaacuagaugcagacaccuagaaagagcauagauaucuaagagaagucugaggacugagcuugguguacucaaagauuuagaaguugagaagaugaaaaagagcuagacagagagacugaaagagugacuacaagaaugaaauauguggaagccaaaugaauaagagcguuaaaagaagaaggaaacgaucaauguguuaaguacuuacccggguuaagaccaggacugagaauuggccauuguuuuuugacauuuagaaaucuuugaaggccuugccaagaauaauuugguugggauaaggagaggaaugaccugacuggagaagguucaagggagaauuggaggagaggaaaugaagagagugauauuucuccacggaauacauuaugugugagagggacuauuagaggaugcagacaagagggcaaaugauuucagagaaaagucccugagugggugagaaggacuaagauuugguauugaaaugucaggaguaugaauuguaacaggagggaaggcagaguacagggguagccauacuguagauuggccacaaagaaaauauucuccaaauggagcuucuuucccccuaagccucccccaaaucauuaccucugcuucugauucaaucccucaaaaccucauccaucagcuugaaugagagacaacuauucagccaccauguccauccgcuuucuuauccccccuugcucacccccagcgucucagcccaaaucuucccuccuuccagccaacaaagcucccaugccugucaucuccugaugucaaugcagcgggcaggggagugggggaccacugaccccacaugccuauucucugcuuagauuacccaaaauaccaggugucguuauuuuucagaggugcaaaaauauaauacaaagucauucuaaacugucacugaauucagaguacuuuuugccauugucuagucacugaauucagaguacuuuuugccauugucuuauuuucucaaucaacaaaugcuaagaguacaauuauaugaaguucuacagauuuauuuguuacuugcauuacuuaguaaugguucuuaugcauaaagguuaggaauaacuucuuugaacaaauauccuauauaaaaaaacaacaaagugguuuuuaaaaaucacauugcuguucacauucccuuuuuaguacucucuucucauauucuuuuuuaagcuauguuaggucaaaacaacuacuuuaauaacuuagcaaauaucuaucaggaguccacuguguaguuagcaguuuauaaagcuucagaucuacauuagugagugaaauggaccuagccccuauccuuacagggcagcaagccugguggaggaagcuauguucucugaaggcaacaaaaacagucaugcgucauuuaagaguagggauacauuuugagaaaugugucaugaaguagucaauuucaucauugaacaucauagaaugcauuuacgcagacuuagaugguauagccuacuacacaccuaggcuguuugguguagcccauugcuccugggcuacaaaccgauacagcauguuacucuguugaauuuuguaggcaacuguaaugcaaugguaaguauuuguguaccuaaacauaucuaaagauagagacaguacaguaaaaaauacuaucuuaugaaaacacuguuguauauguggucugucauugacugaaacaauauuauguagugcaaaccauacagcaacagauaauaaagacaagauauucagagugggagauggaaaagacaauaauguauuccuucauucauuuagcagacauguauugccaaaagacacuggaaaaaauaaauaaaggugacaaacagguggugccuuuguugaagauuauagucauggacagggaaacuuuagcccucuucuuaacauuaucuucccuuagacacaaacacacacacacacaauuccuggcauaugcuauauacuccauaacuguuccuucccuucccuuugugacucauuccuucccccagaaagcucauuugaucucugcaaauaauuuugaauccccuuuguuuuuuaaccauggcaauuguuuuguuuucccaucuccuacaaguuuuagcucaacucguuggggcuguuuuuuuuuuuuuuuuuuuuuuuuuuuuuuuuuuuuuuuugagguggaguuucucccuugucaccugggcuggagugcaauggcaugaucuugacucacugcaaccucugccuccuggguucaagugauuuuccugccucagccucuggaguaacugggauuacaggugcccaccaccacacccagcuaauuuuuguauuuuuaguagagacgggguuucaccauguuggccaggcuggucucgaacuucugaccucagguaaucugcccaccucggccucucaaagugcuagaacuacaggcaugagcucaccaugccuggccauuccuuggggcuuuauagaacaaguauaauccuuuuucuuuaugacaauacccugaguucagaaaucucagagacaaauguuuacagagaccagguaaauaaguagcuagagugacaagacuuaagaaaagagaccauuggcguaccaccaguuuguggagggaacuggaaaaacuggaauacacaugccccauccaaaagcaaccauugcaacuaaacuuuaacagauuguugccaccuaaguaauucacggauggucucauaauucuggucagcauugucugagccaaacaaaauguaucuaugggcaugaucagauacuagagccagcagauugcaaccucugcuuagauaauugcagguaucagccuucccuuggcuaaacagcuacuucauacugauaaguagcccuugccuggcacaaagcagguggggcugaauccagccugauaucacaucaccacaacuuucucuaauucuccucaaggcgucugugaacuaccagcagcccaaauaagcauccuuuucuccuucaaucauuucucauaaagcagauucuacucaucucaccauccaucuuuuuccccuaacauaucagaauucaucaaaguagaaacuccagaaaucauccagaaauacaaaugugaucugaccagcacggguauaaacuuucucuuuccuuaauuuagaaaaaggauuauuaauuuugagucuuagaucucauaaaaguagagcuggauugauuuuaagggaucaaugaaccuacugaaauuguauaaaaagauuuuguggggcuggcaaacaaaugcuuuucuuuuaacauauucuuaaaagaacaaaaccucaaagaagauuuaacaaccacuauagacuaaguuucaauuaauguagucuguagcauuagauuuuggaaggcuguucuaucagaauauggaccaauacugagcguagucgcuacuaaaacucuuugucuuuuuauucauaucuucuccuaaaaagcuccaugaccccugcagaauacugguauaauuacccacaccucacccacccagugauuguugauguaacuaauuauuuaauccaagucugaggccuaaauuuuuuuuaaucaagaguuaguuacauguuuuaauuuauuuuuuguaauuuuaauaucuaacacuuuuauucuauuucauucgauugaugcuaaaaugcauaaugcuaugauucuaagacuuaggaaaaauaauacuauacugggauauggaguuuauauauauuuacaugaauuucuuuuuuuucuucucuguaggucgaaaauuuaaaaaguucaauaaagucagaguugugagagcacuggaugcuguugcucucccacagccagugggcguuccaaaugaaagccaagcccuaagccagagauucacuuuuucaccaggucaagacauacaguugauuccaccacugaucaaccuguuaaugagcauugaaccagaugugaucuaugcaggacaugacaacacaaaaccugacaccuccaguucuuugcugacaagucuuaaucaacuaggcgagaggcaacuucuuucaguagucaaguggucuaaaucauugccagguaauaauaauuuuuauauacagcauguaauaaaaaauauacuauguuuguuguauuaguacauuguuaaauaaaacacucuaugcaguaaauuaacuacaauauaaaacaguaugugauaguauguguuugagcaguucaaaauauuugucuaggacccuaauauguguuacagaaauauaaaaaauuagagaacacacugagucuuacugaugagucagaaauugcauacauuaaacuuaugcuaauaagaaauagcuuagguuuauguguucaaccacagauauuagaguagcucagaaaugauaaauggaccauuuuuuauaaaugcccuauuuauucuaacccuuaauucaaccaaccucauuugguugaaaauaaaacugaauguauaaagucauauaacaaaucaaaguaguauucagaguacaguaaggugucaaaaguaaauuaagaaaacaaaauucccuaacguaaauuacuuuaaaaaauaauagcacacagagaaaagaaucucuagucacuauuccucuaauuuauacccaaagagaguauaucgcccagcaacagagagaacuuggauuauaucaucacagaagaauuucagucacuuuacuuaucagcuauuuuugcucccucagcacagcucuguaggagccaaguacuugaaagaauaacaaggaugaaauucucacuugguuaaaucuuagacugcagagccaggagaauacauguauagcaauuguuugugaaggcauuacuccuauaauuagaaauagaacuuuuuaaaaaacuacauucucuucacaucaguaauacccuuauacugcuauagacaaauuauuuuucuaauaucugaucaagaauuaaacauauuauguccuuuuaguccccaaguaaauucaauggcacuuuuagaaaaagaauuucuucccaauucuccuuaauauaauucucaguuauuauucuaccuaaaagguuugaaauacaauagaugaauuguuacugaaaauucaauuacaugaaacagaaagaaaaauagauaccuguuuguugaaucuuucaaaaaauacauauuaagaaaaguuaauagaauucaguauucuaguggagaugaaguaauuuuauagaaaaaucaaaaugcccagauucuuacuggcuucagucucaccaaaaggccuuaaacagacaauaauuuuuugaacauucuaaauguuuaagauuuaucacauagugguuaucaaacuugacagagcuuuaauaaauaaaaauaacccaauagcauugaugaacuuuuucuguuuaaaaaugaguguuuaaacauguguuuaauuuuucuccauuguucuauuauuuggaaaauaugauuucuuugguuuuuguugauauaguuuauauuccuuuuguuugcaauuuuggagguucuuuacuauuuaaaaagauucuagcaucagcugguaacguuagaaaauaaccaguuauacuugaaaagaugacuuauucacuuuggauaaaagcuaagugaccuuuuuaaccggaaaccguuaucuaucaggacuuuuugacccccacacaaccacaaaaaggaaugagagaaaacucuuacauugaauuugguggcaacuuuuuuaaugcugcaaaauguaauuuuuguguaguaaaucagaauaauggcaacacuaguauuacccauacuguuuccauuaauugcaaacagggaaacauugagauuaucaaagucucuuguggccuguggacuuuuaaagccauauuuucauggucugcauuuugggaauagcacuauugaaugaauuaugaaaauggucagugagcuagagugacuauuugaccucugagaaaggacuuggauggacacauguauagaaaguacuuuaguauuauuagcuacuuaaaacugauuucaauugacuugaaauaagcuuacaguuuuuauucacuuauucacucaauaaaugucuauuauguaccugcuguguucaauaucuaauaauuauacagugguuuagaaagaaaagccacaaggcugggcucaugguguggaugcauuuugguacagcacaugcuagcaucuggucaucaguuuugcauguaaaagaaauuuauuucguucauucacucauguguaauaaaacuaauaagucuguggaagacagacuuuuguuaagugauccucacuaauuagccagaaugucaacuaacuugcuuauuuacagugagacacacacacacacacgcacacacacacaauauaaauauacauaauacuuauguugcuaggagaauauauuaacagaucagaucauucuuucacaauaggaaacuguauuuggaaagucacauuaagaucugaugcagaaugaccaucauaacaaaggugacagcguuuaugaagacaccuaggcauauauuugcaggugcccuaagaauucuuauugccugguagggcuuucucauuucuucuuugucuacacucuuccauuaucuuggaucuguuauaauaaugguaguuuauauuucuucaaaaauauuucagauauauccuuuuguuucuuuucuuuuuuuucuuuuuuuuuuuuuuuuuuugagagagggucucacucuauugcccaggcuggaccacaguggcaugaucuuggcucauugcagccuggaccucuuggucucaaguuauccuaccaccucagccuccugaugagcugguagcugggacuacaggcaugcgccaccuugcuuggcuaaauuuuuuuuauuuuuaguugaaauuggguuuaacuguuuuacccaggcuggucuugaacuccuggacucaagugaucugccugccucagccucccaaagugcuggaauuacaaacaugacucaccgcaccccaccccuuuuacuuuaauagagacuugcaagaugcucuagccuuaugucagcacguuuauaaaccaucucuuaggauacauugcaaaugagugauuuugcaugggcuuuuaucuguagccuuagugggcaauauuuucuuauuugaaauguagagcaacacgauauuugaauuuuuuuaaugaacaagacauauucccucuauuaaggaacucucaauccaguagcagagagaagauacccaaacaacuauaguguuaugugaaagugauauaagauacagauauaaugaaaguggggacagaagaacauuuuuggcuucaaggacuaaagaagccuucagagacaaaaaugucaguuaaacugcaucuuacaggagaaacaagacuuugauaaaucaugauaagagaaagcauucuagauagaaggaacaguauggcugaaauaagaaaagcaugagauagguuugcugaauaaugcauuaaaccagcauauuaaugguucucaaccuuuucaaguguggggggucccuuaguaacaucaaaaauuuuauagucuccccauaggguaguaauuaaagcuuuuaguagcuauggauugagaaaacacauuuguacauacagucccucggacacugcuacaguaaguacuggccuucgggagauuuaaucacccaaaugguaagaaaccauugaaaagaaauuuauuuugaacugaauaauggaaaguaaacuuagagguguaaguuauaggcugaucaaggagggucuuaaaaauuacuguagauguuagaguuuaaauuaaaaguacuaauucacaauucggugucaccuuuaaauuguccucauccuguacaucaauacguugcagugaaauugaugugacagaggggguaugagggaaacacuuccguugcauaaauuuugucuugauauuucaguuaacuuagugaaaacuccauuuaggucaaugcuuugaauuuuuaaaccuugcauuuuuuaggacauacuuuauucuuugugucauuucaccagacuacuugcaauuaucaguaucagaauauuagaacaguauuuugccucauuuuucugcuuuugaagcgugccaaaacaacuuuugagucagugagucauugcaucuugacagaggauuuuuucucuuccuucccgaaucagaagacuaaauuaaauuauugcucuccagaaaaaaaugaugagagagaaaugagaguagcauacugagaguaaaggccuuaauaaauguguugauaaagacuaaaccaugguuuuucucacacccuauuccacugaaauuaugauugccaguggcaacaaaaauuuuuacuugucaaauuagaugaauauuuccagcccuuaauguguuucaccuaccucugggacuauuggcaaaguaacuauuucuugcuaagacucuugcuuagguauuugucacuucccuuccagguagauauguuucucucccuauguacauuucccgacuccuguguggauuuguucuuccacccacacuauaaauuuguuuguguucuggguucuaucuuuuccagucauuucucacucuacacagucugcauaagcucauucauagucuugucuucaacuaccacuauauuucgaugacuccuaaauacauaauauuagccagacccucuacaaaacuacugaacuuucaacugcuuauuacacagcuccacccagaugacuucuaagucagcaugacccccuaaaccuaaggccuuuuccaguaucuugaaauggcaccucagcaagaauuuuugguaucauccuuggcucaguuucuccuucaccccuuacccaauaaauugucaaauucuaucaacuccacuuauuaaauauaugauucauuauacaugcuacuucuguugcuacuucccugacuuaguuuggugcuggucuuuuuuuacuuggauucauguugcagccuccugacugauucuauuaccaucaauuucacguggugcccaaaugauccucuauucuacccccagaaucauuuuucuaaaacaauuuuaaucaaucauauuuuccauuucuuuuuccaaauagcauccaaacuccauggccucaauauccaagggcuuucugugaucuggcuccugaauuugcaguguuaaucucucaucauuccucuucacacgacucuaagaucuaguucccuaaaugcuguuugcucaaauucuagccuucuucucuugcccauauuauuuuuccuaccuggcagcccaucucuuuucccacgucuuccuuugacugaccuguaacuaucuuucaggauucgcauuacuugucacuugcucugggaagauuucucugagccuuccuagacugggugaggaaacccuguacccucccuugucuccuuugugcuugucaaccauaacacuaugacucugaguuacaauuguguucuacuuuucuaucugucucacaagccuauaguguuaaaggcagaaacagcaucuuucuaaccuugauccuaauugcaaguauaaugcuuccucccaaauagaugguuaaagaauauuuauagaaauuuaaauuacagaauugauuugcaaagaacuguacuaccuuagauuauuagacauuaacuucuuauucagcauaaaucaucaaacauacguuggugauuauacuuaaucauauugaagcuucuuugugcuucucaacauugauacuuguguaugaaaguuguugcuuugugucagaaggugcugagauauuuaaugcucugccauuguuguagauuaucuguuucaauuacaugacauuuuuuacagaaccaaaaccuacauauuuuaucaaaacucugggaguaagauuggggaacuuaguaguacugucauacaggccaucuuuuuuuuuuuuuuuuuucuugagauaggcucucacucugucacccaggcuggagugcaguggcaugauuguagcucacggcagcuuagaacuccugggcucaagccaucguccugcuucagccuccccaguaacuucagccuccccagcacuacaggugugcaccaccacaccuggacaagcuuuuuaaauugguuuguagagacugggucuuggcuggucucaaauuccuggccucaagugacucuccugccucgccucccaaagcacugggacuacgggcaugagccaccacacccagccccaggccaucucuucacuauauacuuucuguuaauucuuuaagcuaaauuuggacagcuguaacagggcuuuugucagaaauuaucaggucaagucacuuaaaaggaaaaguguuuuuuuuuuuaacauuuguuaaacacaauuagugauaauccaucacuucuccaugugaagguuuuucauuuuggucaucucaaauguacuaaguuuaccugaucauuaucaucacugggaauuuaaucucuguguucccaucuuuguuucagcauaaaguaaugaaugauauuacaguuaauaaggaaaaaaauagcauuucuauacuaggcauguucaagucaauuuaacauuguacauuuaucacagauaagcacuguaaaagguggaguaaauaaagguuauuuucugaguucuauuccauucugucaaacaaacagaaauauaguuucugcuauaaauauugguaauuuuauaaauuuaaaguuauuguaauaagauuugccuuuaauguugucauaaaauaaaaguaagccuggauuucuagucccagaaugcaaaaacaaagaaaaaagcaaaaagacgaaaacaaaaacuaagaguaggauaaagugaauguaaacauguaaauguagacaggaucuguuuuuggauaaagaacaauuuaauucuuacauaauuuuguaaaauguuuaaauguuuaaaacuacucaaagguuaacauaaaacaaaugccugaagugaaaaauuacagcauaguuaagucaaauauuuaaauauuauaaaauacuuuuuuuagaaaguuauaaaguucaccaagaaagauauagagaauaauaaauguauuuguggagauuauugugaacacuugguuaauguuuuaauacaucugauuaaugaaaacgaacuuucuaugagccuuuuuuuuuuuuuuuuuuuuuuuuuuuuugagauggagucucgcugugucaccaggcuggagugcaguggcacguucuuggcucacugcaaccucagccuccuggguucaaaccauucuccugccucauccucccaaguagcugaugagacuacaggcauacaccaccacaccuagcuaauuuuuguauuuuuaguagagacaggguuuuaccaugcuggccaagauggucucaaucucuugaccuugugauccacccaccucggccucccaaagugcugggauuacaggcgugagccacugcgcccagcccauuuuuuuguauuauaugaaauauauaauuuguuauauauaacaacacacauaaaauauauauucuggaaaauauauauuccagaacaaacacauaauuuaucuuuaaaauuuuuucaccauuauuuuuuauacuucaguucuaucuuauauguucuauaauauauaaaaugccuccuaacacuuuuuuuuauggcauuguguuuuaguauuagagacuucccauuaaacugacugguggauuucauacuaguauuacuccaaugagcaauucuguugcauugauagaccaauaauaaauaucuccauaguguucuacagugugcauaauuaucccauuugucucauagcaacucacugaguuaguuaucauugugaauugugauuuuuacuuaugaagaaauuuagauucaaugauaauaagugauguuuccaaaguggcuguuaguaagugguagagccaggacuggaacuugggucuucuguccugaaugccuuccaauuuguugagacagaucagcaauagggagguuuauaugugccucccuuuagaaaggcuuccuuuucaaaaauuaagacaauucauugaucucuugucaaaugauucuaaauuuuaucacaaaauuacccauuuuuauagucucuuaaauauuugacuuacaagcagcauuuauguauuagauuuauuguauugagcuuuauaauuuucuuaaaaaguuauuauguagaccuauacuugaagacacguucaagucauaugcaaauuaaaaaaugauaaaacuugcauaccaaaaauuuuuuuggcugcuuaguuagagagucuuucugcaccugaguaaaccaggauucuuggaugccaguauuaaaaauaaacuauguuaauuauaaaacacacaagcaacaacaaaaaacccugacuuuuaaaaacaaaagaaaaagaaaaaaaauaauuuacugagaggacaacagggguucacugaauagaagcuagaggacaagcuuagaauaugggcagaagccaaggcacaucugaagggcuaaaaagcaagcaucacaaauccucccauugguucucauuaucuggacaccaccaacaucaagaauaaauagucauaucuuucucuuugcuuuaguauuuucugauucaaauuccuguuaguauauguuccaugggccaaaccuaugccccaagcccaaagaaggaggagguuuacccagcuuucuccgugggaaaguaggaagguaaggcauuugcucucgcaaaaacuacaaccaauggggaacucugcccacacagagaaaggaaggaggggaggaaggaaggagggaaggaaagaaggaaagcaggaagguauuagggagcagugagggaggaggaggaaaaagaggaaaggaagaaagagagggaaggaagaaaggagggagggaggaagggagugagagaagaaaggagggagaaggggaagaaagaaaggagggaaaaggggagggaagaaaggaggaagaaggggagggaagaaaggagggagaaggggagggaagaaagggagaaggggagggaagaaagggagaaggggagggaagaaagggagaaggggagggaagaaaggagggagaaggggagggaggaaaggugggaaggagaaaagguuagacauugaagagcaucccuucucaguaaaagguaaaugcucacuauggcaucucuaauuaugaauaugcauuugaguuuuuggucuuauugaggcuaaggaguucuaagaagagaguagcaauuuuucuacuauucacaugaagaugggacgaucugaaguguaugaagagaagagccuucuuuuuugcuaccuaccuugacaugauuaacauugucaggaaauaacuuucuuuugcucuugauagcuaaugaauuaaguuuugcuuugguuuuacuuuugaaacagauuauuuguaagaacaucaguggauuuuuagagaaaauagauguuuuuaaaacagcuuuauagaaagugguugauguucucagcaaaacauugucuccauaccuuuaauuuuaaaaauucuccauuuucaucauuucaguuauacucagauacaaauaacuuucaaauuuauauuaauauuuuuagcccauauaucuccccauacuucuaauucauaugugcagcugauaccaggauguugaccccugaauccuauccaaaacuauuuucucccuagcaaguuucuucuccuuuauuuuaucucagcaaugcuguuaucaucaucuacccuucaagacaaauacugaaagauguauuugauuccuucuucuucccaucuaccggcaaucaguugacaaaugucuuuuauuuuucccuuuaaauauuuuucugaugcacucucuccucuuaauuccaauguguugacuugacuuacuucaggcuuuuaucaucucucaccugggcuuugacaguaucucccaacuguccucccuaacuccagacuuauucccuugaauccaccuaccacauagcuaagaaugauccaucuacaaugcaaggcuaugucacucccauugcuccuuaauagacuugcaagaccuuggaugaucugacccagccuacaucucuaaacacaucuuugcuucucccaccuuuaaguuacucauuguugaacuggugaucuucccuugagaauugggaagacauggagagacuugugaugauuaagucaagauucauuugcccuuucccugccauccuucugccaccaacaccauggaacagccuaaaagaggaugaaagaccaaagcauucacaccauaccccccaauacacacacacacacacacacacacacacacacacacacacacacacacacagauucuaaaucucuuaagccacacggaaguuuaaaacaagacuggauuaaguuucagagaacgaaagugaccugaugacuguggaaucuacccgacauaguuaaggguuguuaaaagaaaauuagauauaacacaacugaaagcagugguuuuacaaaguaagaccaguuuauguuuaaaucccaaagaacugagauuuaacgaacugauuauauuccauucaggcauuaucucucuuuuuuucuagaaaguuuuuccugaccucccucccgauugacugauacacucccuuuuaaccuucucuaccccagcacucaugugcuuguuucuccuguugaguugugagcugcuuuugaggcuaggauugacucuuacucaucuucauuuuuauacagugccuggcacccaaaugguucuuauuaaauggguguugcaugaaugagugauggaugauggauucacuuagcaaaaucccagaaaugcuaaaucacagugacuaauuucaagugacuuccaaaguugcugauauuuuaggcuguauuauuuauuaauguuuucugauuuucaguguaaaauauguugggauugaaaacauuuuauuacccuacgcauaccuauuuucagauuuauauguauuuucaacauuuuugagauaauucagucauuuuuauggucacuguauuuuuaaauuuguuuuguagguuuucgaaacuuacauauugaugaccagauaacucucauucaguauucuuggaugagcuuaaugguguuuggucuaggauggagauccuacaaacacgucagugggcagaugcuguauuuugcaccugaucuaauacuaaaugaguaaguaguaacuuuuguuguuuuuguuauuuuaaguguacauguaggauaauuuugaaaguuauauuucaauagaugaucacauauuuaguguucuugauaugaugacauuacugucauuuuacgguaauuuuauauuuggagcuuuuuccucuuguuucaaaauauaguuauaucaaauccaauuuucuuacacaucaagaauguaucaagaaauauauuuaaagauaaacuuaaauguuucauuaaucaauuuaaaauuucauagcuugguacuaaugacaauaauaaaugagaaauauuuuuguuacugacuuacauucaaaaaguaaaaacaucuuucuucauacaugacaaauuagacugcuaauuuauuuaaaaaauugaaagauaaauauuucaauuugcuuuauauuuaaauaauuuuaauuaauuuucuaccuacaaccuuuaacugaauaagaaucuuuucaugguaauauuuauauuguucuagugguaaaugcugacuuagaaguauauaacucacacuuauauaagucuuuacaguuuuuagauaauuuucauguuucauuacauuuuauccaacaauuccuugagauaaguaaggaaucagcauucuucauuguacaguuuagaaaacugagucucaggagaauuauauaaucugccaaauaauuugaaugacagugagauuccuuaucucuuuuuagccaaaaucuaguuuucauuauucuuguuagcuucauuugacuaauguggacauuauaaaacaacacaagguugggaaaaugccuuaauuaaauuuucucagccuucagcacuuguguuuaacuuugucaauuaauuaaugcuugccaauguccucuuuuacucuuuucuguaucauuguauauuucccuagaaaaguuuaaaauaugguaagcuuugugaacugacuucuccuauuuaauugcacacaaaauuauauaauuuuucauagaaaauaaauuguaaguaaauaaaacauuucugagcauucuucagcuucacauucucaacuccuacaccucugcuguguuuucuugguuuagguauuuaaagugugauaauaaaagugagaaacaauguuaaucuuggucacuguguauuuaauauaauuuucuaguuuuaagauuucuuaaccucaaaaauucaguauugugaaaaguuuagaagauguuuaaaauuccaaauauuggguuuguuuauuaaaaguaguagucauuuucaauaauauguaagguaauuaccaaaaccauauucccugauaaauuaccuaaacuggcugagacacuauuuuuuuuccuguugcuuuuucuuuuguguauugugugugaugcaagacagcggaugaaagaaucaucauucuauucauuaugccuuaccauguggcagaucccacaggaguuugucaagcuucaaguuagccaagaagaguuccucuguaugaaaguauuguuacuucuuaauacaagugagugaguucaaguaacuuaaugcaagauaucuaguuucuuaauucauuagaaaaguugcaaacaauaugauuauauaguuauguaugagguagacgucuuggauuauaaguauaaagaagaaauacccaauauauuguuauagacauuaauaaaauuacuggauuuuuucaucuuuuaccuaccauauaauacuaaaauagccucaucaauuucuuuuuauuuuagauaaaaugauuuaauuacucuuucauauucaccuaauucaguaauauaaacuacagucaugugccacauaauaauauuuuggucaacaacagaccacauauacaaugguucccuaagaugauaguggagcugaaaaauuaucaucgccuaguccuguuauagccaccauaacaucauagcacaaugcacuaaucacauguucguggugauacuaauguaaacaaaccuacugugcugccagucauauaaaguauagcacauacaauuauguacaguacauaguacuugguaaagauaauaaaaaacucuuacugguuuauguauuuacuguaguauacuuuucuauugagagucacuacuucuacuuuuuuuaaguuaaccgcaaaacagccucaggcaggucugucagagggauuccagaaaagggcauacgucacccugggagaugacaacuccguguguguuacugcccccugaagaccuuccagugagauaagauguugggguggaugacagugauauugaugauucugacucuguguaggucuaggcuaauguguguuuuggguauuaguuuuuuuaaaaaaaguuuaagcaaaaaagaaaauauuuaaaaauagauaaaguuuauagaauaaagauauagagaaagaaagccaggcacgguggcaugugccuguaguccccacuacuugggaggcugaggugagaggaucacuugagcccaggaguuuuaaguccagccuaagcaacaugugagaacuugucucuaaaaaaagaaagaaagagaacuguaccuuguguuuuuguuuuuaacuaaauguuauuacaaaagagucaaaaaguuaaaaaacuagaguuuauaaaguaaaaaaguuacgguaagguaaagcuaauuuauuauaaaagaaauaaaaauauuuuuauaaauguaguguagccuaaguguacaguguuuauaaaggcuaucguaguguauaguaauguccuaggccuucacauucugucaccacucacucgcugacucacgcagagcaacuuccaguccugcaaguuccauucauguuaaguccccuaugcaagugucccauucguaucuuuuauauuggauuuuuacuaugccucuucuguguuuagauacaaaacacuuaccauuguguuacagcugccuacaguauucaguaaucacaugcuguacagguucauagccuaggaauaaggccuagguguauaguagucuauaccaucuagguuugugugaguacacucugugauaaucacacagugaugaaaucacauaaggacacauuucucagaauauauccccaucauuaagugauacacgacugcaauuaauauuggauaagcacaaaccauacucuccucuaccaccacucucaccccauccccaaaguauuuacuauauaaaauacauaauuuuguuuagaauuauuuuuaucaagauaaauuguuaaaacauguaacuauaaagauuagcaucuuaauauaauagugguuucuuuaucacugacacaguccagugaguuagcaagaaacacccaggcuccuucuagccaguggcuucaccccuuccuaguggcuugcaaaccucuauuggacaugacuagaaaugagcacugagugagagagauuuugaaggcuagaucugaaacuaucauacaucacuuucacccacauuccaaggcacuuaagcugcaggaaaagcugggaaauacagucuagcuauaggcccagaagaaagaggaaauuauguuuuauaaagcauugcauugaucaccagaaggacaggcaaauauccguuccacuuuuucuuauauccaaggaacauacuuaccucugccucaguggauccccaagggucugggugggcaaaguuuuaaaaaaaagaaaaagcagcugcuuugacccuugcauaggcaggaucagcccucaaauguacaaacugaugcuuuugugauucauugugauuucuaugacaaccacagggagcuaagaccucaggccgagggugagccuaaggucuuucuuggcaacaucuuuacagggacuucuuucuaaggucccaaaucucaaauggcuagggggugcagaucaggagggaagggcaggagagauaaacccugaaauggaaggcuuccucauagaauuuaugcaaagacagggaugaauacauaaccaucuugggaacccuauuuggacaaggaauuucaaggcuaauuuggugacagagcaucaauugaacaaaggauauuuacguggaaccggcccagagagucaacuggaauacauuuaauaauacaguaauuagcuccugcccuucuuugcaugaaggaaugaauccuauagcacuuaugucacagauaguccuagaucuuccaaacuggcuuauauccuuaacauaauucucuauuuauggauaggcaacauuaugcuggggaauuaaacaacaauggaauuaaucaacagggaggcuuugcucauuguugucacuuagaaacuuaggcgaucacuagagcagugguaagaaaaggaagugagauucauacaacuuccacucacauaccauagagaguaagauuuuuagccauuugccacuucacaaaaaggaagaaaaagaaacuauuuaaugaauaguacuuacgcuuuccacaaauucuaaucaagauucuaaugagauuuggggagaagagggugaacuugacaaaccuacugaaaauccaucuuuaaaacuagaagaauaaauagauaagcauuauaaaaauaugcagggaauuagaaagcugcuguuaauuaauacagcaugggagaagagauauacugaacuuuugggcaaaucagacaaguauauauuagaauauaaauaguauaguggaaaccacaaaucaaugagucugaaacaaauaaauguuaagaaaaauaguuuuauauuuggaaaaaaacuguuuggauauguagcucaaauuauauccuugaauaacagauaauugaguuaaauguaaacacucaaauaauuaaaaaacaagcuagaagaaauagaaauaaucuucaaucucaaauaccuuuuauaaaauaaaugcaaggagaagauuggcaaaguaaaacuuugauaauuugguaguuaugaacuuaaaccucucauuugccauuaaauaugaaaauauaaaucuccaggaauagacaguagguugaacaaacauuuuuacauuguucucuccaaaauuacacuaaaggccagauguagucggucacauuucuaaucacacuuugggagggcaagcugggcagauggcuugaacccaggaguuugagaccagccuaggcaacuuggaaaaccccgucucuaaaaaaaaaaaaaaaaaaaaaaaaaaaaaaaaaaaaaaaaaaaauuagccaggcguaguggcaagugccuguagucccagguagccgggaaacugaggugggaggaucaccucaaccuaggaagucgaggcugcagugagccaugauugugccacuguacuccugccugggugauugagugagaccaugucucaaaauaaaaauaaauaaauaaauaaauaaaaauaaauaaauuacacuaaaaucuuaguaaagggauuuacuaugaaaaauuaagaaaaaaugauuuuacauucauguuuacagcugagggaaauauagggauugguugguaaccuuaaagagagcugugaaaguuugaaaugacugcuauuugaaguaguccagaaaauuaguacagccucuauggaacaccauauggagauuucucaaaaaacuauaaauauaacuaccauucuaucuagcaaucccaccacuggauaucuacccaaaggaaaagaaaucauuaugucaaaaagacaccugcacucuuguuuauuacagcaguauucacuauagcaaagauaggaaaucaauccaaguguguaucaacagauaauaggauaaagaaaaugugauguacucacacauauacauacauacacacacacacacacacacacacacacacaaaauggaauaguauucagcaaucaaaaagaaugaaagugugucuuuugcagcaacauggauggaacaggaagucauuaucuuaagugaaacaauucagagacaaagucagauaccacauguucucgcuuauaagugggagcuaaauaaugcauguacaugggcauagaguauagaauaauugacaguggugccuuagaaggcuggaaagguaggaggggggugagacauuaccuaauggauacaaugugcauuauugggugaugguuauaccaaaagcucagauuucaccacuaugcaauauauucauguaacaaaacugcacagauggucauuaaauuuauacaaauuuaauaaaaagagguucuagauauacauauagauguacauacuagaguuaaguuuucaauugacaaaaauuugcauagauauacugaauugccagaauuacucuucagagucuccuuuauauacaagaucuugaaaacucaaaaccaaagaauuaacuuauuuguuuuucauaaguuuguaucucuggccuucuuuucuaggggaaauggaaaccaaguuuugauuggggugcaggggauaaauacaggcuuaagaaauaguaauuuuccucccuguucccugagauacaacaauauuggaauuaggccaaggcugggcaugguggcucaagcccguaauuccagcacuuugggaagcugaggugggcgaaucacuugaggugaggaguucaagaccagccuggccaauauagugaaaccccaucucuaccaaaaagacaaaaauuagucggacaugauggcacacacuuguaauccuagcuacucaggaggcugaggcgggagaauugcuugaacaugggaggcggagguugcagugaccugagauugugccacugaacuccagccugggcgacagagcaagacccugugucaaaaaaaaaaaaaaaaaaaaaaaagcaauuaggccaacuaacaaucuuggaauggccucucaguguuccaguaaaagaaagaguugcaagucugagguagaaaugauuaagcuuaauuaggaaggcaugucaaaaguugauauagguugaaaacuaggucuccugagccaagcaacuagccaaguuucaaauacaaaguaagaguucuugaaggacuuuaaaagugccauuccagugaacacaugaaugauaagcaaaaccgccuuauugcugauauggagaaaguuuuaguggucugaauagaagaucaaaccagccacaauauucccuuaagccuaagccucauccagaggaaggcccugauucuccucaauacuaggaaggcaaagagauguaaggaaggagcagaaaaaaguuugaagcuagcagaaguugguucaugagauuuaagaagccauuuccauaacaaaguauaaggugaagcagcaagugcugaugcagaagcugcagcaaguuacccagaagaucuagguaagauuaucgcuacuuaugaaaguagcugugcuaaaaaacagguuuucaggguagauaaaacagcuuuccacuggaagaagaugucaucuaggacuuucauagcuacagagaacaagucaaugucugucuucaaagcuucaaaugacagguugacucucuuguuaggggcuaaugaagcuggugacuugaagcugaagcuggugacuugaagcugaagcuaaugcucauuuaucauucugaagauccuaaggccuuuaagaauuacgcucaaucuguucugccugugguuuaugaauggaacaacaaagcuggaugacagcacaucuauuuauggcaugguuuacugaauauuuugacccacuauugagacuuacugcucagaaaagaauacuacuuucaaauauuauugcucauugacaaugcaccuagucagccaagagcucuuauggauauauacaaggagauuaauguuuucauuucugcuaacacaacauucauucuguaguucauagaucaaagaguaauuuuccacuuucaugucuuauuauuuaagaaauauauuuuguaaagcuguggcugccauagauaguguuuccucugauggaucuggguaaaguaaauugaaaaccuucuagaaaggauucaccuuucuagaugccauuaagaacauucgugauucaugggagaaggugaaaauagcaacauuaacaagaguuuggaagaaguuuauuucaucccucuugcaugacuuugaggguguucaaaacuucaguggaggaaauaacuacagauaugugaaaagagcaagagaacuaaaauuagaaguaaagccugaagacaugacugaauugaagagguuucgugguaaaacuugaaagaugaggaguuguuucuuauggaugagcaaagaaagugguuucuugaguuggaaucuacuucuagugaagaugcuaugaagauuauugaagugacaacaaaggauuucggagauuacauaaacuuaguugauaaugcagcagcaggacuuaagaggauugacuccaauuaugaaagaaguucuauuguggguaaauugccaucaaacugcuagcauugcaugcuacagaaaaauuauucacaaaagagucaacugaugcagcaaacuucauuguugccuuauuuugagaaacugucauagccaccccaaccuucagcaaccaccacccuggccaaucagcagccaucaacauuuagacaacacccuccaacagcaaaaagauuuugacucagggaagacucagaugauuguuaccauuuucuagcaauaaaguguuuuuuaguuaagguguguucacuuuuuaaauaaugcuguugcacacuuaauacauucuaguauaguguaaauauaacuucuacguggacugggaaacaaaaagaugcaugugauucacuuuguugcaauauuuccuucauugccguggucuggaaccaaaccggcuauaucuccaagauaugccuguguaacaaaguggcuggauauaagauaaauauuuaaauauuaauaccuuucucccauaucagcaggaaggcauuagaaaacuuaaugaagcaauuuuuaaaauuacaacaaaaagauaaaucaucuaggaauaaucuuaauggcaaauacuugagauuuauauaaagaagacaaaaguuuacuaagagauccaaguauucauuaaaaagaagggaaaaaaaagauccagauuacaugcagcuguaaacuaagucaaaccaaguauuuaagaagcauguagaauaaggccagguucucuuuugagcaaaugcuaaguuaaaugcacaauccauugauacaggucuaaaauaggucagcugaaguguucuuuaauauaccuauuaauucuuauguucuuccagugaacuagaaguuuauauguccugauauugauagugauaucaauaacacuaucucuuuccuauauaagguguuuuuuuucuagagucauguaucagaagaaaucauuauauagcucagaaauauauguuauaaauuguuaaugucaucuuuuuauacacaacugccacuuuuaauugucuucuuaacaguuccuuuggaagggcuacgaagucaaacccaguuugaggagaugaggucaagcuacauuagagagcucaucaaggcaauugguuugaggcaaaaaggaguugugucgagcucacagcguuucuaucaacuuacaaaacuucuugauaacuugcaugauguaaguauuugguugauuccagaauaucaaugauuauucucugaauuucuauaacuuuuuaaauguuacauguaaauuuuacuuuguaugauuuucucagauuaauacuuguauguuaaaaguguuuggaucaugcugcucagacuuuuuauuguguuuuuuuuucauuuucaauauagaccacucaaauauucuuuuacaaguauuuguauaaugugaggguaauuuaauagcugauagaaauuaugguacauuuccugaauauguucuaaaauauuugugccuaaaauuauaaaagauuuuauauauacaguaaaaacaaagguauguaugugaaaaauaagacucaugccauuuucaguggaauuauaaauaacauugcugaugggugggcaaucaggcaauacauagcaaaaguuaaaauuugcaugcuuuucaaguuucuauuuuuuaggauuuaucuuaaagaaauaauuagacaaauguaauauacaugcaaggauguucaccauagcagagggggaaaaaagaaaagcaaacaagaaaugcccaacaccagagguggauuacuaagacaagauaucugugguuugucaagauauaugaaauacaagcuuuuauugcuacuauguucagaucacauuaaaaugacagugaaggcauaaaaaagcuauccacucuccaggucaacuuuugaggucuuacuccugaauacgaacagacagccaagauuaugagcuauuugaguaaagccucuaaaaugaaaggcagaaagcaaaauaaaaagaaacuugaaggaaauaaacaccagugcagagaacagaagaaaacuucuaacauccucagagaaauaagaaugauacgguauccaugacaugagaacagaaaacauuuuuaaaacagacauuuagcaagaaaauacuuuuggauaauuaaaugaagaaaggcagaaauugaaaauucaaugaaagggcugaaauggaaaggaaaaucugaggaaaaauaaaagaucaaaacauggaaaauuagaaagaagaguuauaguaaauuuaguauucaggagauucuagccuccaauuaauaggaauguccagaagaaaaaauagagaaaaucaaggagagaaauuuguguaagaaaucgcaaaaguugcuggaacugaaacauacaaguuuucuaacaaaaaggguccgguguagaggcacugcacaauugaacuaagguacauuauuguaaaauuguaccaggccagaaaugaagagaauauuuuaaaguauaccagugaugaaagaaacaggucacauagacguuaucaggauucagaaugauguuggacuucucugcagcaacacuggaagccagaagacaguggagcagugccuucagaauuugauggaaaagaaaaucuucaaagaauuucauaccuagccaaaccaucaaacaaguacaauggcagcaugaaaguauuuuccaacuugcaaggucuccuagaguuuaccucagauacaacuuucucaagaacugcuacaggaugucuuauaacaaaacaugggauuaagccaaagauccaccccaacagagaugcaaagugaugucccagaacaauaacugugcagagcaguaguuagucuagaugggagcaguaauacaaaggguucuaggauaccagcuccaggaaaaauaaauggaacugagagauuaccacuaaguaugacuguaauugaggugauuuuuacaauucuguugcagaauuugacuauggcuuugagacaaauauagagaaaacaaagcaaacaagaacacgaggugauucacuuuugcaaaauaaaaauaagucguaagaauggagaugcaauccagcagaaaaccauaaaaaaaucuuuaugauauaaaugcuggauauugacuuuagcuaaaaauugagccaaaagcucucucuggggagaagagaacauguauguaguugaggaagagagugucuaguauaagagagcuucauuuucuucauuuccuauaguagaaacuaaaacuaacuuuaguggaaauauagaaauaucaaaagacacaggcuacaaaaaguugaagguaguugugucuagggagcuggaauagggaugggaagaagucuaucaggaaacugcuaggcucuauugaugcugcugcugcugcuguuuuuguuuuuauaaucaugugguacuacuugacuuucaacauuauacacaugaauuacuuugauaaaaauuaaacgauguuggauuauuggcauaggaagaaccaauauguuguuauauaaaacagcuagauuagcaaauagaauuuaugaaacauguguaauauuguguguaugcuuggguaugucuguauacauguauaaaaagaaaaaaaaacuugaguaauacaccaaaauguucacacagcuuauccuguagaauugugaauaacuuucauuucuuuaaauaaaucuuuccauaauaucagaauguucuaucaugaguauauaacauuuuacauauuauucuagaaaauggugggaguuauuuucacuaugguaagaaaaaaacaccuugagaaguauuuauauuauaaauaguuagaaaaauaaauugccauguuugaauagcauaugaauuuauuauuuuuauuacauguuuucuacucauuuguuaaaccaacagcuugucaaacaacuucaucuguacugcuugaauacauuuauccagucccgggcacugaguguugaauuuccagaaaugaugucugaaguuauugcugcacaauuacccaagauauuggcagggauggugaaaccccuucucuuucauaaaaagugaaugucaucuuuuucuuuuaaagaauuaaauuuugugguaugucuuuuuguuuuggucaggauuaugaggucuugaguuuuuauaauguucuucugaaagccuuacauuuauaacaucauaguguguaaauuuaaaagaaaaauugugagguucuaauuauuuucuuuuauaaaguauaauuagaauguuuaacuguuuuguuuacccauauuuucuugaagaauuuacaagauugaaaaaguacuaaaauuguuaaaguaaacuaucuuauccauauuauuucauaccauguaggugaggauuuuuaacuuuugcaucuaacaaaucaucgacuuaagagaaaaaaucuuacauguaauaacacaaagcuauuauauguuauuucuagguaacucccuuugugucaauuauauuuccaaaaaugaaccuuuaaaaugguaugcaaaauuuugucuauauauauuugugugaggaggaaauucauaacuuuccucagauuuucaaaaguauuuuuaaugcaaaaaauguagaaagaguuuaaaaccacuaaaauagauugauguucuucaaacuaggcaaaacaacucauauguuaagaccauuuuccagauuggaaacacaaaucucuuaggaaguuaauaaguagauucauaucauuaugcaaauaguauuguggguuuuguagguuuuuaaaauaaccuuuuuuggggagagaauuguccucuaaugagguauugcgaguggacauaagaaaucagaagauuauggccuaacuguacuccuuaccaacuguggcaugcugaaaguuagucacucuuacugauucucaauucucucaccuuugaaaguaguaaaauaucuuuccugccaauugcuccuuugggucagagcuuauuaacaucuuuucaaaucaaaggaaagaagaaagggagaggaggaggagggagguaucaauucacauaccuuucuccucuuuauccuccacuaucaugaauucauauuauguuucagccaugcaaaucuuuuuaccaugaaauuucuuccagaauuuucccccuuugacacaaauuccaugcauguuucaaccuucgagacucagccaaaugucauuucuguaaaaucuucccugagucuuccaagcaguaauuugccuucuccuagaguuuaccugccauuuugugcacauuugaguuacaguagcauguuauuuuacaauugugacucuccugggagucugggagccauauaaaguggucaauaguguuugcugacugagaguugaaugacauuuucucucugucuugguauuacuguagauuucgaucauucuuugguuacauuucugcauauuucuguacccaugacuuuaucacuuucuucucccaugcuuuaucuccaucaauuaucuucauuacuuuuaaauuuuccaccuuugcuuccuacuuugugagaucucucccuuuacugacuauaacauagaagaauagaaguguauuuuaugugucuuaaggacaauacuuuagauuccuuguucuaaguuuuuaaacugaaugaauggaauauuauuucucucccuaagcaaaauuccacaaaacaauuauuucuuauguuuauguagccuuaaauuguuuuguacuguaaaccucagcauaaaaacuuucuucauuucuaauuucauucaacaaauauugauugaauaccugguauuagcacaagaaaaaugugcuaauaagccuuaugagaauuuggagcugaagaaagacauauaacucaggaaaguuacaguccaguaguagguauaaauuacagugccugauaaauaggcauuuuaauauuuguacacucaacguauacuagguaggugcaaaacauuuacauauaauuuuacugauacccaugcagcacaaagguacuaacuuuaaauauuaaauaacaccuuuaugugucaguaauucauuugcauuaaaucuuauugaaaaggcuuucaauauauuuuccccacaaaugucaucccaagaaaaaaguauuuuuaacaucucccaaauauaauaguuacaggaaaucuaccucugugagagugacaccucucagaaugaacugugugacacaagaaaaugaauguaggucuauccaaaaaaaaccccaagaaacaaaaacaauauuauuagcccuuuaugcuuaagugauggacucagggaacaguugauguugugaucauuuuauuaucugauucuuguuacuuugaauuaaaccaauauuuugaugauauaaaucauuuccaccagcauauauuuaauuuccauaauaacuuuaaaauuuucuaauuucacucaacuaugagggaauagaaugugguggccacagguuuggcuuuuguuaaaauguuugauaucuucgauguugaucucugucugcaauguagaugucuaaacacuaggauuuaauauuuaaggcuaagcuuuaaaaauaaaguaccuuuuuaaaaagaauauggcuucaccaaauggaaaauaccuaauuucuaaaucuuuuucucuacaaaguccuaucuacuaaugucuccauuacuauuuagucaucauaaccauuaucuucauuuuacaugucguguucuuucugguagcucuaaaaugacacuaaaucauaagaagacagguuacauaucaggaaauacuugaagguuacugaaauagauucuugaguuaaugaaaauauuuucuguaaaaagguuugaaaagccauuugagucuaaagcauuauaccuccauuaucaguaguuaugugacaauuguguguguguuuaauguuuaaagauguggcacuuuuuaauaaggcaaugcuaugcuauuuuuucccauuuaacauuaagauaauuuauugcuauacagaugauauggaaauaugaugaacaauauuuuuuuugccaaaacuaugccuuguaaguagccauggaaugucaaccuguaacuuaaauuauccacagauagucauguguuugaugaugggcacuguggagauaacugacauaggacugugccccccuucucugccacuuacuagcuggaugagauuaagcaagucauuuaacugcucugauuaaaccugccuuucccaagugcuuuguaaugaauagaaauggaaaccaaaaaaaacguauacaggccuucagaaauaguaauugcuacuauuuuguuuucauuaagccauaguucuggcuauaauuuuaucaaacucaccagcuauauucuacagugaaagcaggauucuagaaagucucacuguuuuauuuaugucaccaugugcuaugauauauuugguugaauucauuugaaauuagggcuggaaguauucaaguaauuucuucugcugaaaaaauacaguguuuugaguuuagggccuguuuuaucaaaguucuaaagagccuaucacucuuccauuguagacauuuuaaaauaaugacacugauuuuaacauuuuuaagugucuuuuuagaacagagagccugacuagaacacagccccuccaaaaacccaugcucaaauuauuuuuacuauggcagcaauuccacaaaagggaacaauggguuuagaaauuacaaugaagucaucaacccaaaaaacaucccuaucccuaagaagguuaugauauaaaaugcccacaagaaaucuaugucugcuuuaaucugucuuuuauugcuuuggaaggauggcuauuacauuuuuaguuuuugcugugaauaccugagcaguuucucucauccauacuuauccuucacacaucagaagucaggauagaauaugaaucauuuuaaaaacuuuuacaacuccagagccaugugcauaagaagcauucaaaacuugccaaaacauacauuuuuuuucaaauuuaaagauacucuauuuuuguauucaauagcucaacaacugugguccccacugauaaagugaaguggacaaggagacaaguaauggcauaaguuuguuuuucccaaaguaugccuguucaauagccauuggaugugggaaauuucuacaucucuuaaaauuuuacagaaaauacauagccagauagucuagcaaaaguucaccaaguccuaaauugcuuauccuuacuucacuaagucaugaaaucauuuuaaugaaaagaacaucaccuagguuuugugguuucuuuuuuucuuauucauggcugagugaaaacaacaaucucuguuucucccuagcaucuguggacuauuuaauguaccauuauuccacacucuaugguccuuacuaaauacaaaauugaacaaaaagcaguaaaacaacugacucuucacccauauuauaaaauauaauccaagccagauuagucaacauccauaagaugaauccaagcugaacugggccuagauuauugaguucagguuggaucacaucccuauuuauuaauaaacuuaggaaagaaggccuuacagaccaucaguuagcuggagcuaauagaaccuacacuucuaaaguucggccuagaaucaauguggccuuaaaagcugaaaagaagcaggaaagaacaguuuucuucaauaauuuguccacccugucacuggagaaaauuuaagaauuuggggguguugguaguaaguuaaacacagcagcuguucauggcagaaauuauucaauacauaccuucucugaauauccuauaaccaaagcaaagaaaaacaccaagggguuuguucuccuccuuggaguugaccucauuccaaggcagagcucaggucacaggcacaggggcugcgcccaagcuuguccgcagccuuaugcagcuguggagucuggaagacuguugcaggacugcuggccuagucccagaaugucagccucauuuucgauuuacuggcucuuguugcuguaugucaugcugaccuuauuguuaaacacagguuuguuugcuuuuuuuccacucauggagacaugggagaggcauuauuuuuaagcugguugaaagcuuuaaccgauaaagcauuuuuagagaaaugugaaucaggcagcuaagaaagcauacucuguccauuacgguaaagaaaaugcacagauuauuaacucugcaguguggcauuaguguccuggucaauauucggauagauaugaauaaaauauuuaaaugguauuguaaauaguuuucaggacauaugcuauagcuuauuuuuauuaucuuuugaaauugcucuuaauacaucaaauccugauguauucaauuuaucagauauaaauuauucuaaaugaagcccaguuaaauguuuuugucuugucaguuauauguuaaguuucugaucucuuugucuaugacguuuacuaaucugcauuuuuacuguuaugaauuauuuuagacagcagugguuucaagcuuuuugccacuaaaaauaccuuuuauuuucuccucccccagaaaagucuauaccuugaaguaucuauccaccaaacuguacuucuauuaagaaauaguuauuguguuuucuuaauguuuuguuauucaaagacauaucaaugaaagcugcugagcagcaugaauaacaauuauauccacacagauuugauauauuuugugcagccuuaacuugauaguauaaaaugucauugcuuuuuaaauaauaguuagucaauggacuucuaucauagcuuuccuaaacuagguuaagauccagagcuuuggggucauaauauauuacauacaauuaaguuaucuuuuucuaagggcuuuaaaauucaugagaauaaccaaaaaagguauguggagaguuaauacaaacauaccauauucuuguugaaacagagauguggcucugcuuguucuccauaagguagaaauacuuuccagaauuugccuaaacuaguaagcccugaauuugcuaugauuagggauaggaagagauuuucacauggcagacuuuagaauucuucacuuuagccaguaaaguaucuccuuuugaucuuaguauucuguguauuuuaacuuuucugaguugugcauguuuauaagaaaaaucagcacaaaggguuuaaguuaaagccuuuuuacugaaauuugaaagaaacagaagaaaauaucaaaguucuuuguauuuugagaggauuaaauaugauuuacaaaaguuacauggagggcucucuaaaacauuaaauuaauuauuuuuuguugaaaagucuuacuuuaggcaucauuuuauuccucagcaacuagcugugaagccuuuacugugcuguaugccagucacucugcuagauuguggagauuaccaguguucccgucuucuccgagcuuagaguuggauggggaauaaagacagguaaacagauagcuacaauauuguacugugaaugcuuaugcuggaggaaguacagggaacuauuggagcaccuaagaggagcaccuaccuugaauuuagggguuagcagaggcauccugaaaaaagucaaagcuaagccacaaucuauaagcaguuuaggaauuagcagaacgugcguggugaggagaugccaaaggcaagaagagaagaguauuccaaacaggagggauuccaaagagagaagaguaucccaaacaacauuugcacaaaccugauggggagagagaaugugggguggggauggaugaugagacugaagaagaaagccaggucuagauaaucaguggccuuguacaccauguuaaagaguguagacuugauucuguuguaaacaggaaagcagcacaauucauaugaauauuuuagaagacucccacuggaauauggagaauaaaguuggagaugacuaauccuggaagcagggagaacauuuuugaggaaguugcacuauuuuggugaaaaugaugaucauaaacaugaagaauuguaggugaucaugaccuccucucuaauuuuccagaaggguuuuggaagauauaacauaggaacauugacaggacugacgaaaggagaugaaauacaccauauaaauugucaaacacaaggccagaugucuaauuauuuugcuuauguguugaaauuacaaauuuuucaucaggaaaccaaaaacuacaaaacuuaguuuucccaagucccagaauucuaucuguccaaacaaucuguaccacuccaccuauaucccuaccuuugcaugucuguccaaccucaaaguccaggucuauacacacggguaagacuagagcaguucaaguuucagaaaaugagaaagaggaacugaguugugcugaacccauacaaaauaaacacauucuuuguauagauucuuggaaccucgagaggaauucaccuaacucauagguauuugaugguaugaauccauggcugggcucggcuuuuaaaaagccuuaucugggauuccuucuauggaaccaaguuccaucaaagcccauuuaaaagccuacauuaaaaacaaaauucuugcugcauuguauacaaauaaugaugucaugaucaaauaaucagaugccauuaucaaguggaauuacaaaaugguauacccacuccaaaaaaaaaaaaaaagcuaaauucucaguagaacauugugacuucaugagcccuccacagccuuggagcugaggagggagcacuggugagcaguagguugaagagaaaacuuggcgcuuaauaaucuauccauguuuuuucaucuaaaagagccuucuuuuuggauuaccuuauucaauuuccaucaaggaaauuguuaguuccacuaaccagacagcagcugggaaggcagaagcuuacuguauguacaugguagcugugggaaggagguuucuuucuccagguccucacuggccauacaccagucccuuguuaguuaugccuggucauagacccccguugcuaucaucucauauuuaagucuuuggcuugugaauuuaucuauucuuucagcuucagcacugcagagugcugggacuuugcuaacuuccauuucuugcuggcuuagcacauuccucauaggcccagcucuuuucucaucuggcccugcuguggagucaccuugccccuucaggagagccauggcuuaccacugccugcuaagccuccacucagcugccaccacacuaaauccaagcuucucuaagauguugcagacuuuacaggcaagcauaaaaggcuugaucuuccuggacuucccuuuacuugucugaaucucaccuccuucaacuuucagucucagaauguaggcauuuguccucuuugcccuacaucuuccuucuucugaaucaugaaagccucucacuuccucuugcuaugugcuggaggcuucugucagguuuuagaaugaguucucaucuaguccuaguagcuuuugaugcuuaaguccaccuuuuaaggauaccuuugagauuuagaccauguuuuucgcuugagaaagcccuaaucuccagacuugccuuucuguggauuucaaagaccaacugaggaagucaaaagcugaauguugacuuucuuugaacauuuccgcuauaacaauuccaauucuccucagagcaauaugccugccuccaacugaccaggagaaagguccagugccaaagagaaaaacacaaagauuaauuauuucaguugagcacauacuuucaaagugguuuggguauucauaugagguuuucugucaagagggugagacucuucaucuauccaugugugccugacaguucuccuggcacuggcugguaacagaugcaaaacuguaaaaauuaagugaucauguauuuuaacgauaucaucacauacuuauuuucuauguaauguuuuaaauuuccccuaacauacuuugacuguuuugcacaugguagauauucacauuuuuuuguguugaaguugaugcaaucuucaaaguuaucuaccccguugcuuauuaguaaaacuaguguuaauacuuggcaagagaugcagggaaucuuucucaugacucacgcccuauuuaguuauuaaugcuacuacccuauuuugaguaaguaguaggucccuaaguacauuguccagaguuauacuuuuaaagauauuuagccccauauacuucuugaaucuaaagucauacaccuugcuccucauuucugagugggaaagacauuugagaguauguugacaauuguucugaagguuuuugccaagaaggugaaacuguccuuucaucuguguaugccuggggcugggucccuggcagugauggggugacaaugcaaagcuguaaaaacuaggugcuagugggcaccuaauaucaucaucauauacuuauuuucaagcuaauaugcaaaaucccaucucuguuuuuaaacuaaguguagauuucagagaaaauauuuugugguucacauaagaaaacagucuacucagcuugacaaguguuuuauguuaaauuggcuggugguuugaaaugaaucaucuucacauaauguuuucuuuaaaaauauugugaauuuaacucuaauucuuguuauucugugugauaauaaagaauaaacuaauuucua

SEQ ID NO: 193027 - RNA, 129592 nt, Homo sapiens
uuccgggaggaguuuuggccuccacacggcuccgucgggcgccgcgcucuuccggcagcgguagcuuuggagacgccgggaacccgcguuggcgugguugacuagugccucgcagccucagcaugggggaacauggccuggagcuggcuuccaugauccccgcccugcgggagcugggcagguagggcuaggcccagccuggguccugcauccuccuccgcugauuccggcuuggguuucacgugcucuccccuccccugcugcgcuauggcugggauccccuaagcccccgcugcggcccuuguggagaugcuccguggcugauuugggcgcuucucccucagagugcccguugauagcacauggggcagucgccacaaaccugcgggaagccgguccgugggggagagaggcgucugccggcccugguuuaccacucaccccgaucgagaguuugcuuccugcagcuggaggaagagucccugcugaucgcuuucuggucacuuuucuacacucauuuucuucucgaaaaucuuuuuccuuagacgagggacuugacccaucaguuucuguucuuugugaucacucguggaggaauugguuuuuagccuuacauuuuguccccaaacugcccuugaaagaaaaucaccgcuucucauuuucugcaagugacaucacuugcuggaaaaggcaguuuuuuucuuugaagugaagucauaguacauacugaagaugugaccucccucguauugaucguccaguucccgauccguuauuuuagucagaaauuggagagauagaccccuggguccacaaaaucucagcgugcacagaguguugccaaaauuuggagacaauuuaauauuucauuugcaaaugcauguugucuguaaaccucaugaaaaccaguaucuuaccacaaggagggagagguguugauggcucucacaccucuucaauacacaggcaggcuucccugaaccaggccuaaagacucgguagagcuuguuuugcuuuguuuguuuuaauucuacacuacugcgaacaagaaauaaauaagcuugugcugcuaccgcaguuaaauuaucauuuggaauaacugcuucccaauuucuuaaacuguuugaaaacuuuccacacaaagucaaagcugacauuaagccaaugggauagcuacuucucuuucuuuuugcagcgcaguuguguucauuuccacugguuggccauccaaauaaucuagucucaauauaugaauaaaaggauaaaugaagggaccauucuugucguaacugcaucacuauuuuugagugugugaauuuuuuccacuuaucuguggcaaguauacuuuguguuuaguuuauaaaauaaccucuaccucucuaaaagaagaggaagaaaagugaucauuguaggaaguugguuuacaaauuucaucuuucaggcucauugugaagcugaguauauuuuugccacuuugcuuuaaaguagaauuaacugguuaauacuucucuucccucuucugucuuccuccgugaguccuguuaauaaaaauaauugguucuuggauuauauauagucgguuucaucaguagaguuuauguuaccuuucauuuauuuguagcuauuccaagagaaagaauagaaaaacugacccacagagaguugucuaauaguuuuuaauugucauggcuuuuucauuacaacuacuugaaucaaaaaagcuaaucaauuuucauaguauauccaugacauagaaugaaacaaguguuaccacuguuuaagaaaaagggacagagaaguugaagaaccaaaggcacagcuagcagauaacagagcuagguuucagauucaagcuuucaaggccuuuucuuccaaaauguuuccucuuaauugacuauggcaauuagacuacugaaaaaaaaagauauuaguguucuaauuuaugggcugcucuuccucagucccucagauaaauuuuguccuauuguuuuuuugcuauuagcagucugcucugcauaaucuugcuaaaugaccuuuccacucuccugccuucaacuauaaucugcuauuugaugacuacuaauauguuucuccaaaucaugucuucuauagaauuguauauuuacuguauacugguaguuucacugaguguccuauguguaguuaagguucagaauauccaauacaaauuccccacauguccuagcuuucacaagcuuucuuuuuuuaaauuaaaaaaauuauuuuucucuuauucauugaaguagagauaucucaguacauggcaccauauucacuuaguucuccaaacuggaaaucuagaagucauucuuaacuauuuucacaugugcuuucagucuauguccuuggcccucuuuuaaucugugcugucuucccaaguaaucuuaccuaaucucauggcuuuaaaugucauccauaugcugauaacucccaaauuuauauuucuagaucggagauauauauuagguugcuuacucaacauccacacugggaagugaaaauuaacauauccaaagcagaacgccugauuuacugcgcccuugaauuuguuccuucuccuguguuaucguaaauaugccaaccaaaagccuaggagucauccuugguuuuuuucccuugucgcuuaauaauccauaaguuaguucugacaaccauauguuuaagauacaucuagaaucuaacacuucucacugucuccacugcuaccaccagaauuucuuaccugaacuauuacaguaaccuuaguugaucuuuccauuucuacuuuuaccuacuuauaauagauuuuccacucaguaaagugauuuuucaucuauuagucauauuguaaguuccccugcacaaaaccguccuuugacauuccagcacacuuaaaaucaguauaaaauccaaacuccuuaccaaggccucuaagguucuacauaaucuggcucagccugccucugacuucaucaccuuuuaucccucuuuugcuuacuuuacucuagugauacugaccuuguuucuccaggauaccaaggcuguuccugccuuuaaucguuugcuguuccuucuaucugaacacuggaugguuucauuuagaugucauuucagaaucaccuucucugauuuuccuacuugagauugcuuuguaguuguaagacauuuucaaaugugauaguugcuauuaaaauguuaaauggaacagugggauguggaggagguucugaggagcagcagcauuagccacuagaggagauuugaugguguaaagaagcuagucacgugaaucugggauggaauaggaaguacaaaggcccauaagugggaaugagccugcuuuuuuuuuuuuuuuuuugagacggagucucgcccucuccaguggcgugaucucugcucacugcaaccucugccucccggguucaagcgauuuuccugucucagccucccuuuccuguagcugggacuacaggcuugcaccaccgagcuaauuuuuauauuguuagugaagaugggguuuuaccauguugcacagguugucuccaacuccugaccucaagugaugcacccaccucagccaccaugccaaggcugaaugagccuacuuuuaaaaggauaguaagaaggcuggagcacagggaguaaagaggggagugguaugaguuaaacagggagggguaggcaagggccacauccuucagcaccuuggaggcuagaaaaaggagugagauuuuauugugugaugggaaaccauuggaaucuuuuaaacagggaaauaagcaaguuuuuuaaaacuugcuuaauuuuuacuuccuuaaaauccuucagugcuuacacauugccuucaguguaaaauccaaacuacuuagccaguccuuugaaauuuaaccuuaucuucccucuucagcugcaucucuaaaggcuuuagccacauagagccucuuacaguuuccagugcuuggacuacccucccucuuacccuuauuucacugccuugucccuuagggagucaguuuuguaucaccucguuaaggaagccaugacugacagggcccugcucagggcugagugucccuuuguguucuuucuugggccugucaguucuuaaccauaauuaccucuuguuuguccuuuaaucugcaaauuauuuuagggcaggugcauucugucuugguuauccugguauuugaugcuuaccucagaggaggugccuaagcuuuauauaauacuuacauuaauacucaaauuuuauaguaugcuuuugaaaaguuauacccucuuagcucaguuccaggguagaagucacaaaauaagaagugcucacuccugugaguuuucuuucuuuuuucuuuuuuuuuuuuuuuuuuugagacuggcucaccuguugcucaggcuggaguucaauagcaugaacaugucucacugcaaccucugccuccuggggucaagcgauccucccaccucagccucccaaguagcugggacuacaggugugugccaccaugccuggcuaauuuuuguauuuuuguagacgggguuucaccauguugcccaggcuggucucaaacuccugggcucaagugauccgcccaccucagccucccaaagugcugggauuacagacaugagccaccacgcccggccaaguuucuuucuucugauaguagaucuaaugaaugguaaucaauuuacauuuuucuaaaacugauuuuuaaaaauuacacaaauaauacaugaguacauaaucuuuacaaaaugaaacuuuguaagaaacucugaccacuacccacaauccuggcuccucuucccauguuccucuuuguucacauuuuuaaaugauacuugugaaauuacugugguuuaucauaaugucuccugacuuugucuaaaacaauucauguuaccuuguaauuacagauuuugaauuuuuuguuaaauuugugaugcccuauacuaugguagccacuagccaaaugugaccauugaccaccucacaugcggcuagucuaaauugagaugugcuguaaauauaagauacacaguggguuucaaagacuuaguaccagaaaaaagaauguaaaagaucucaugaauaauuuuuauaucgauuacacauucaccuaauauuucagauauauuguuaggaucaauuguuuuuuuccuguuucuuuucuuaauguggcuaccagaaaauaacaaaauuauggcuuacguuauauuucuauuggccagcgcugauuuaaauaagauacauagcacuaaguuguuuugcuuucauaugcaaauguaacuacuuguucuuugauucuuuuuuuuuuuuaaggacuuuauuuaguagcauauacaaacuugcuuuuuuuuuuuuuuuuuuuugagaugaagucucacucugucauccaggcuggagugcaguggugcgaucuuggcucacugcaaccuccaccuccaugucccagcgauucuccugccucagugccacagcuucccaaguaacuaggauuauaggcgcccaccaccacgccuggcuaauuuuucuaucuuuuaguagagaaaggguuucaccauguugggcagccugaucuggaacuccugaccugaagugaucaguccgucucagccucccaaagugcugugauuacaggcaugagccaccacgccuggcccuuugauucuuugugucuagaguuuauguuacuuaaaaacauuuguuaauuucaguaaguuuuucuauuaagcaaguucuaggugauguagcagaggcaaaaagaaauaaaaugcauuuucucuccuauaagagcuuacggucuaauggcacuuuaggacaugcagagagaaauaaagcacagucugccaccuguaggagcuuauagucuaguggcagggaauagguaaauauuccauagguccagaaggcuguacauuaggaaugaagaaaccacaaaauucaggaagguucuuaugaaccauucauucauugaagaguuguuuuuuuuucuuuaaaugucuacuauguaccaggaccagagaacaguucuuuuuuuucuuuucuauuuuuuggagacaggggucugguuuugucaccgaggcuggagugcagugacacaaucuuggcucacuguagccucccaggcucaagcgauccucccaccucagccuccugaguagcuggggacuacaggugugugucucuauaccugcucauuuuucuauuucuuuuguagagacaggguuucaucauguugcucaggcuggucucaaacuccugagcucaagcagucugcccaccuuggacucccaaagcacugggauuacaggcaugagcuaccaugcccgaccaguaucaguucuuuuauggcauuuauuagcuguaaaugcuauugauccuauauguaaucaauuaggauuggacuuugugguuugaauaaucaaaaaaaaaaaaaaaaaaaaaaaaaaagucaggccgggcgugguggcucacgccgauaaucccagcacuuugggagaccgaggcggauggaucaugaggucaguaaaucgaaaccauccuggcuaacauggugcaaccccgucucuacuaaaaauacaaaaaauuagccgggcgugguggcacgugccuguagucccagcuacucgggaggcugaggcaggagaaucacuugaagcugcgaggcggagguugcagugagccgagaucacaccacugcgcuccagccugggcgacagagcgagacuccgucucaaaagaaaaaaaaaagaaaaagggccgggugcgguggcucacgccuguaaucucagcacuuugggaggcugaggcgggcggauuaccugaggucaggaguucgagccagccuggccaacauggugaaaccccgucucuacuaaaaauacaaaaauuagcugggugugguggcacacgccuguaauccuagcuacuugggaggcugaggcaggagaauugcuugagcccggguggcggagguugcagugagccaagaucgugccacuaacugcacuucacccuggccgacagagcgagacucuguaucagaaaaagaaaaaaauucacucuuuuucuuuuaccacuauuugagauaauaaguggggaaaauguaugaacauuuuacagugcuauauagaaauaaauugugacauauaugaaauauaugcuauuauuuauaaguaacugucuuacuacacccuaaguuguuuugucagaagugauggacuuugcuaaucacucacacauaacccacugugaauccucuagguagaguuaaucauucccugcuuuggguguacaugauacuugcuuuugauuauuuauuuauuuauuuauuuauuuauuuauuuauuuauuuauugagacugagucucgcucugucgcccaggcuggaguacaguggcgcgaucucgacucacugcaaucuccgccucccagauucaagcgauucuccugccucagccuccugagcagcugggacuacaggcgcccgccaccacacccagcugauuuuuguguuuucagcagagaugggguuucaccauguuagccgggaugguuuagaucuacugaccucaugauccgccugccuuagccucccaaaaugcucguauuacaggcgugagccaccaugcccggccgcuuuugauuauuuaagugcauuccucuccucuccccagcaacuauucugaguucuuugaagcagaggaucuuguuuuacuugccuuuugaauuuauuaaauuauuugcgucuguacccauccauucuuucuauguuuaugaaagaguuacccuccuguccaaggauugucuuuuuacuuauaucugguuccaagaagaggagucacaucucaagaauugguugcuuaggucuuuccauuauaagggagaaacaaaacaaagcccucuugaucucauacaguucuuuaguuaucaccaacucuacuucucuucauuucaugaucaagcuuuggaaagaacccgcuauucucaguauucacauuucauuagauuuucagccccuugcaaucuggcuucucucuuuacugcuacaggaaaauuuuaaaaguccaaaaggcauacaaauaccuaaacauaagaacuaaaacuaugaaacucuuagaagugaacauagagggggccgggcaugguggcucacaccuauaaucccagcacuuugggaggccaagauggguggaucaccugaggucaggaguuccagacuagccugaccaacauggagaaacccugucucuacuaaaaauauacaaaauuagccaggcguggugguacaugcuuguaaucgcagcuacucaggaggcugaggcaggagaaucgcuugaacccaggaggcggagguugcggugagcugagaucgcgccauugcacuccagccugggcaacaagagugaaacucugucucaaaaaguaaauaaauaaauaaaaauaagggaacauagagggaaaacauuaugacacuggauuuggcaaugauuucuuugauaugacacaaagcacaggcagcaaaauaaacagauaaauuggaauucaucaaaauuaaaaacuuugugcaucaaagggcaguaucaauagagugaaaaggcaacccauggaacuggagaaaauauuugcaaaucauaugucugauaaggaguuuaauaucuagaauauauuaagaacuccuacagcuuaacaacaaauauaaccugaugaaaaacagaaaaagaacuugaauagacauuucuccaaagaagauauacaaauggacaaauaagcacaugagaagaugcucacaauuacuaaucauuagggagaugcaaaucaaaaccacaggauacuguuucacacccauuaugauagcuauuaauaaaaaaacaguuggggcugggcauguuggcugaugccuguaaucccagcacuuugggaggcugaggcaggcggaucacgaggucaggagauugagaccauccuggccaacaugguaaaaccccaucucuacuaaaauacaaaaaauuagccaggcaugguggugcaugccuguaguaccagcuacuugagaggcugaggcaggagaauugcuugaacccgggagacagagguugcagugaguugagaucaugccacugcacuccagccuggugacagagcaagacucugucucaaaaaaaaccaaaaaacaaaaaaaaucccacaaaaaaaaaacacaguugggcauggugacucaugccuacaaucccagcacuuugggaggucaaagcaggcagaucgcuugagcccaggagauugagaccagccugggcaacguggugaaacccugucucuacaaaaaauacaaaaaauuagcuggguguggugacaugcaccuguggugccagcuacucaggaggcugaggugggaggaucuccugaggcugggagguugaggcugcagugaguuaugggugcaccacugcacaguaaccugggcaacaggguuagacccugucgccaaaaggggaaaauaaaauaauaauaaaaaaacacccagaaaauaacguguguuggugaagauguggagaaauuggaacccuuguccacugcaggugggaguguacaaugguacagccacuguggaaaaggguauuagcguuccaccaaaaauuuaguuuuuaugugcuucagaagggaggaagugaaugcuaauugguccauaggcagucaugggugggccuggaaaaagcacccuaaguucucgcugugguccguguaacuggcagccaggcuuccaggcuucaagcuguuccuggcuugaaggugggucuucacuggggacccaccccuuuccucccaggagccuacuuccugcugccaucaaccugccacccacuacaccgaggcuguucgugccgaggggcgccugcaggcccauauugagcugcccucagccuaccgcuuggccugcccaaaguccagagggagaugaggcagcagggggcuggugugucagugccguccugagcacaugcacacgcggccugguccugacaacaccugggcucccccacaacuuugcuccgaaauuggugugggugccgggagcggggagaggccaggcagcgggagcaggcauuuccaagucugugagggcagggggccuucccggcccuggaaagagcagggaugccuggguuugcagccgugguugggcggcugcagcugcacccaggauggcugggcucccgacccugcaacucggaagggggcggggcuuccaccugucuugcaccucagaagggggcggggcuucugcccacuagcgcccuggagagagcagcccuagcaccaccuuccucaccgcuccaacugggcugccacugccaucaauagcacauuucaauuuguacuaaucacauuucaaguucucccuaguuacuuguagcuaguggccaccauauugagaaguucaggucuaggcuuugcugauuggaucucuuuaguauuacuuagcauauucuuuuuuuucuuguaaguugguaacauauucagauuuucuuuucaauuuuuaaacagaagaauacugugaauaucaacauugacacugaacacauuugaugaguucuacuuuagagaaauuuuuuuugcaaaugaaacugagucacuuuaaggauuaaaagcuuuuaauuuguauuuuagugccacaccagaggaauauaauacaguuguacagaagccaagacaaauucugugucaauucauugaccggauacuuacagauguaaauguugguaagaaaccaauuauuucuuauauaaacuuuauaaauuagacuuuucuuuuccauguauaaauuauaguagcauuuucuccauguaguuuuagauauggaguauuuaugauaguuacuauuuucaagcaaguuauuuguuaaucaguauugcuuauugcuuguuacaaaauuugaauuaggcuuuuaaaauaauucucuuuuccuguuuguuaucuagauuuucuacugcuugcuaugaguucuuuaauauuggauauuauauguaaaaauauuuguccaguaccaaucauguggacccuauuuugguuagcuguuaugccagugguagacuaauagcaaaugccacccaaaaaaaccucuuuaaguaaguuacucuuuaaguagguucaugccugugccuauaggagauuauaggauuaugugaguuacugaaucaauuauugccuguuugugccaaucugcuagacagaauauuaccaaccuggcaagauggugucacauuugucauaucuguugaaauuacaugggagggauaauauaaaauggcauuaggcucaggguuuauaauuuggauuccaaauuuggcgcagauuuuaugacuuagacuagccauuaauccuuucuuuuucaaucaguaaaaugauggguugcugaaaaauaacaaaggacuacugaauacuuacaagauguguuuuuguaucguauucauauucccuccguuuagacuacuugcccuuccccucucugaccaacuccucaucuaggaaucauuuccuucacaguguccucccagauaccuguuucuccuuauucuggauuagugcuguuaccauauuguauuauaauuauuaguugguuuguuuggcgccccacuggauugugagaacuuuuuuuuaauccuuagauuuuagcauugccuggcauauuauuccugaaguacauguuugauaaauagauguaugguagaggaaugcaugugauuuuuaaacauuuaaaauuagauaagacuguaguguuggcugggcacgguggcucacgccuguaaucccaacacuuugggaggccgagguggguggaucaccugaggucaggaguuugagaccagccuggccaacaugacgaaacccugucucuacuaaaaauaccaaaauuagcugggugugguggcacacaccuguaguccuagcuacucaggaggcugaggcagaagaaucacuuguaccccggaggcacagguugcagugagccaagaucacaccacuacacuccagccugggcaacagagugagacugugucucaaaaaaaaaaaagacuguaguguuuagccccaucaauuuagcuugaauguuguugagugcugugcuggauauaauucuggucaccaaagucugguuccccacccccaccccacuuuuuguuuuuuuuuuuuuaauuuuaagagacagagucuugcuuuguuccaggcuggagugcaauagugugaucguagcucacuacugccuugaacuucugggcucaagggaauccuccagccucagcccccugaguagcugggacuauaggcacacuaccacucccagcuaauuuuaagaaaaauuuuuuuuguagagacgggaucuugacaucuuauccaggcuggucuugaguuccugggcucaggugauccgcccacuucagccucccaaaguacagggguuacaggagugaggcaccuugccuggcccacagucugguuucuuaacaaaaggaccauuguuuaauuugucaugacucuuuaaaaugaaucuuauuguuuuaguugcuguagaacuuguaaagaaaacugacucucagccaaccuccgugauguugcuugauuucauccagcauaucaugaaauccuccccacuuauguuuguaaaugugaguggaagccaugaggccaaaggcaguuguauugguaagugcuguuauucaugcauucacuugccaucuguucuauaaaauccuccuuuuacugcucuucugaaauauuacauguacaggauuauacuuuuuugggucagcuuugcuauaaauugaaggagcaaaaugguaaugguuauuuuuccuucacauauccuuauuguuuucuuuuuaguauuguauacuagguacuuagaaauaaucaaauuuguuuauuugccauugaacacuuuggcaugguuuucuuuuuucuguuuuugguaaucucuuucuucuagaucagagcuuggcaagcuguaguccacaggguggcugccuguuuuugugaacaaaguuuugguguuuuguuuuguuuccuuuuuuuuuuuuuuuuuuuuuuuuuaaauaagacagggucucgcuauguugcccaggcuggucuugaacugguagacucaagggauccuccugccucagccuccugcauaccugggaccauaggcacaugcuacugugccuggcuucaguuuuuguaaacaaaguuuuauuagaacacagccaugcucauucuuuuacuuauugucugugacuacuacaaaggcaacuugggcacucaagccaaaaauauuacuaucugguccuuuaaaaaaaguuugcugaccgcuauucuauauauugaagcuuuucucuaggcuuauucuuuauugcaccuacuacuuuugucccuucauuggugucuucauaaagagaugcaaaauaaacauuuuuuuuguauaauggauaaaguauuuuaaaauuuuuuguucaaacuuuaacucaacuuugauagcauguccuccaagaaguuuuuuucugagcacuacuucuaacugcuuagaacuggcuugguuauuccuuuauucucucuuaguacuaaguguucugcauuucaucuaucauagaggcuauuaaacugugcucuaaucauugguuugucuauauucuuuccuacaguaguuuuuaaacuacaggucauaacccacuaguggguuaugaaauuaggcaauuaucagcauuuaaaacaagaugaaauaaacuagaaaauaucauaggcugggcacgaugucucacgccuguaaucccagcacuuugggaguucgagaccagccuaggcaacauggcaaaauccugucucuaccaaaaccaaaccaaaccaaaccaaaacaaaacagaaaaacauuagcugaacaugguggcacaugccugugguacaagcuacuuggaaggcugaggcacacuaauugcuuuagccugggaggcagagauugcagugagcuaagaccaugccguugcacuccagccuggguaacagagugagaaccugucucaagaaaaaaaaaaagaaaauauuauaguacauuguauguaauaagaguaaguacuauuuaaugaaccuuuuguuuuaaauauuuaaauaaaaugcauguauauguacugggucaugauauaaaauguuauuucuuuguugcagucaaaaagcucaagaaacuguacugugagauucaugaggacaggacuaugacugauuuauucuuguguaccugagacagagucaccacucaaauuuuaguugaaagaaugacaauagcuacccuuuauugaacauuuauuuuacuuuggaacugugcugaguauuucaugugcauuuucuuauuugguccucacaguaacccauaacauagauagcauuauucuccuuauacaugaaauuacagagguucagagaaaugaaaaguuuauacaacuaguaaguggaaagcuaggaccuugccugucugacuccaaaguuguuacaggcauaccucagaaauauuguggguucaguuccagaccacuacaauaaagugaauauugcaauaaaguaagucacaugaauuuuuugguuucccagugcauauaaaaguuauguuuacguuguaccuuaaguguggaauagcauuaugucuaaaaaacaauguauguacccuaauuaaaaauacuuuauuacuaaaaaaugcuaacgauuauaucauccuucaacaaguuguaauauuugugcugguggagugucuugccuugauguugagggccuuucucuggauuaggcuuuggcuuaagggaauguuguggcugguuugaucuucuuuuuuuccuacuggaaauuuccucaucuuuuaacgauuugaucuucuauucagaguacaaaaacuuucuccauaccagcaauaaggcuguuucacuuucucaucaauggugcguucaguggaguaguacuuuuaauuuccuccaaaaacuuuuucuuuguuuuaacaaguugguuguuuggugaaagaggccuagcuuucaacuugucuuggcuuucaacaugccuuccucaguaggcuuaaucauuucuagcuuuugauuugaagugagagaugugugacucuuccuuucauuugaacacauagaggccauuguaaggguuauuaauuaaccuaauuucaauacugugucucagggaauagggagacacaaggagagggagagagauggggaacugcuggucggugggucagaacacauacauuuauccauuaaguuugccaccuuauaucggugugguucaugacagcuccaaacaauuacaauaguaacaucaaacgucacugaucacagaucaccauaacagauacgauaauaaugaaaauguuugaaauauuuugagaauuaccaaaaugugauacagagacaugaagugaccacaugcuauuggaaaaauggcacugauacacuugcuugaugcagaguuaccacaaccuucaauuugugacaaaugcaguaucugcaacgugcaauaaaacuggguaugccuguguucuaaacuauuauguuuccauugugaagagaauguuuuacacucuuguuagugaaguuuauucuuuaaaagucaaucgucaaggauuuagcaaaugaauuagcacuucggauauacuuguuuauuuaauaucuuuuuuguuuauuucaaagaauucaguaauuggaucauaacgagacuucugcggauugcagcaacucccuccugucauuuguuacacaagaaaaucugugaagucaucuguucauuauuauuucuuuuuaaaagcaagaguccugcuauuuuugggguacucacaaaagaauuauuacaacuuuuugaagacuugguuuaccuccauagaagaaaugugaugggucaugcuguggaauggccaguggucaugagccgauuuuuaagucaauuagaugaacacaugggauauuuacaaucagcuccuuugcaguugaugaguaugcaaaauuuagaauuuauugaagucacuuuauuaaugguucuuacucguauuauugcaauuguguuuuuuagaaggcaagaacucuuacuuuggcagauagguuguguucugcuagaguaugguaguccaaaaauuaaaucccuagcaauuagcuuuuuaacagaacuuuuucagcuuggaggacuaccagcacaaccagcuagcacuuuuuucagcucauuuuuggaauuauuaaaacaccuuguagaaauggauacugaccaauugaaacucuaugaagagccauuaucaaagcugauaaagacacuauuucccuuugaagcagaagcuuauagaaauauugaaccugucuauuuaaauaugcugcuggaaaaacucugugucauguuugaagacggugugcucaugcggcuuaagucugauuugcuaaaagcagcuuugugccauuuacugcaguauuuccuuaaauuugugccagcuggguaugaaucugcuuuacaagucaggaaggucuaugugagaaauauuuguaaagcucuuuuggaugugcuuggaauugagguagaugcagagguaaguaauuuuucagguuacuaguuaaguauguauuuuguucaucauuuaauuguauacauaugugcaaaauguaauaauaagaaaauagaauaucuuuaauaguaauuuauauuuggaacauaaugauuuucauaguguagucuggcucacuauuauggacuuuuacuuugauuucagaaggauuuguucauuaaguugguaaugaacugccaauggaguagaauguuucuaaguagaaucugugaaguguaaauguauuuguugcauuauuaauuaaaagggggcaguuaccaacuuaauugcagaagcuuuggucaaucagauuaugugucugacaaguuauaaucaaucacuuuuagaaaaccuaugaaugauuaaucaugccaaauuaugcgcuuuuuucuauuuggacugugggagucagguaauacaauaaaaucaucagagaugcaguaacuugauuaaauauuuuaguuuauuaaucuugcuggauuaaaguuacaugaagaaaguugguaauucccuuacagaauuuuuuauaagggaauuaaaauuuauagcauuuugguaagaggaaaaacaggauguagagagaaggauuuguuuaaaccuucuaagacuauagaaccauagucuauauauagacuuaaauaauauagaucaauuuagauguuuauuuugcuuuaugagacucuaaaaguaguuucacuagaaaacaccuaacaucuaauacauucuugcugccuaugaauaauauaaauauauuuucuaaggaauauuucuggaaauuauuuuuuauuuucucaguacuuguugggcccacuuuaugcagcuuugaaaauggaaaguauggaaaucauugaggagauucaaugccaaacucaacaggaaaaccucagcaguaauagugauggaauaucacccaaaaggcgucgucucagcucgucucuaaacccuucuaaaagagcaccaaaacagacugaggaguaugaugaccuucauucaguuuguauuuagccauuaaauaaaacuuuguucacuuuuaaaaaucagcuuuaguuaagugcuuugauuuaaauacacaaagaacaucuuucuaaauguagccaagggagugcuuaaaauauuuuuauaauuauuguagacgguuaguaguauaaaacauuucaugguuaaauauaguuacuuugcauguuuuuauaugcuuaucuaauuuaacuuuuuaauaugugaaaaaucuuugagacugugcaucuauuagcaauuuuuaaaacauuaaccaacuauuuuuuauaaaguggcuaaguugccauauuucaguuacuucugaacauuguuuuaauuguuuuaaaucuuaguauaaauuucaggcugggcgcgguggcucacgccuguaaucccagcacuuugggaggccgaggcgggcagaucacgaggucagaagaucgagaucauccuggcuaacacggugaaacccugucucuacuaaaaauacaaaaaauuagccaagcguggugguuggcgccuguagucccagcuacucgggaggcugaggcaggagaauggcgugaacccgggaggcggagcuugcagugagccgagauggcgccacugcacuccagccugggagacagagugagacucugucucacaaaaaaaaaaaauuuuuuugaauaguugauauuacauaguauguuuuauucuaaauauguuucauguuuuaaccaaauuuauauugcauaugaauaucucucuacuauauucauaauuauagaauuaaacauguggacaugaaccaaaagagcauauuauggagugcacugaaacagaaagcugaaucccuucagauuucccuugaauacaguggccuaaagaauccuguuauugagauguuagaaggaauugcuguugucuuacaacugacugcucuguguacuguucauuguucucaucaaaacaugaacugguaaaacaaacuucuuguuucuugggguuggguuuccuguaaugaacuuggauuuacuguuuacucauuauucacuugacucauguaaccuuagaacacaaacuuuucacugaaguaguuaauaaauuuauuuucuauugagucaaaugcuagguacggugcuaagcacuguauauaucuuaguuaauauuuacaauaguccuguaagguaaaggcuauuaugccuauuuuaaaaauuagaaacugacacucagagaaacugaggcucuuuuuugucugaagccaaaacugacuuuccuggggacacaugauuagaaaguaccagaacacauuuguguacaacucaaaacccaguguuuggcuguugaagacagggucucgcuuugucucccaggcuggugcacaguggcaugaucauggcucacuacagccuugaucucuauccggggcucaagugagccucccauguagcuggaacuauaggcaugugccgccacacccuaauuuagaaaaaauuuuuuuuguagagauggguuucccuauauuggcccggcuggucucaaacuccugggcucaagugauccucccaccucaggcucccaaagucauuugguucccaaauccuaagggugauuuaagcugacauaaauagauucaacuuaaaauaguaauaacauauuacuugauuugcauguuuacuuuaaauuguuauagauaaauuucguacucacaauuucuuuuggcuuuacuacaauuuuauguuugacuauaacaaaauucaucuuaauuccaauguuuuuaacaaaauguacuuacugcagccguacuuucaaggacugucaacauaaauccaagaagaaaccuucuguagugauaacuuggaugucauuggauuuuuacacaaaagugcuuaagagcuguagaaguuuguuagaaucuguucagaaacuggaccuggaggcaaccauugauaagguggugaaaauuuaugaugcuuugauuuauaugcaaggugaguacaaauuagcaacagaucagaauaaccuuuaaagauaaucaguauagaaauaugcuuucuuuuuugccugaagccuaagugcguguuuggaauacucagaaguuuuuuccugauuucaguucuauuaaauuugucaauaauagaaguucugaguugccaauuuaugugcauaauauuuugauucuuuagucaauagaaauuauuuauaacuucaaaguuuuuuaauuugggaguuugaggaaugccgugauucuucuuuaaaacaggcauagauaacauguuuuuauaaagucacauuuaauuucuuuggguucacagaccucagaccaucguuuauagaucucuguguuaagaauuucugcuuauccaaugaucauuaugauaguauuucaaaugucuuuauuuuuauuuaaaagagauaugauuaaggaaaaguuauaauuaaugacuuauuuugugcuucuguaguaaacaguucauuugaagaucauauccuggaagauuuaugugguaugcucucacuuccauggauuuauucccauucugaugauggcuguuuaaaguugaccacauuugccgcuaaucuucuaacauuaagcuguaggauuucagauagcuauuguaagugcucacaagaaugugugugugguuuguuuuauuuaucuaucuaucuaucuaucuaucuauuuauuuauuuauuuauuuauuuauuuauuuauuuuugagacggagucuuacucugucgcccaugcuggagugcaguggcgcaaucucggcuugcugcaaccuccgucuucagguucaagcaauuuuccugccucagccuccugaguagcuaggauuacaggugcgcaccaccauacccagcuaauucuuauauuuuuaguagaggcgggguuucaccauguuagccaggcuggucucgaacuccugaccucaagugauccaccugccccagccuucuaaagugcuaggauuacaggcgugagccaccaugccuggccuugugugguuuguuuuaacucaucucuauauaggacuucuaagacuuauuuauauuuuuuucaauaauuaaaagagcagguacauuuuuaauaguucagaaggggguuagauacauaaaaaguaacacauaaaagccugccccacauaucccauuuccuuucuuuuuguaaaacauuugcaauguguccuuacauaucauuaucuucauuuaauaaaauuaggaaguauuugagaaauauuuuaaaaagaagaacaauauaccaaaaauucuuauaccaacuucucaguuuaagaaauagaaacauuaggccaggcacgguggcucacgccuguaaucccagcacuuugggaggccaaggcaugcggaucucuugaggucaggagcuugagaccagccuggccaacauggcaaaaccucaucucuucuaaaaauacaaaaauuagccaggcaugguggcucacgccuguagucccagcuacuagggaggcugagauacaagaaucucuugaacccaggaggcagagguuucagugagccaagauugcaccccugcacuccagccugggcuauuagagauaugauggaagccuuugucccucuaugauuucauuccccucauuuuuuuccccagagauuacuacuguucugaauuugguguugauuguucuguugaauguucuauuacuuuuacuauauauguauuuauuuauaaauaauauaagaaauuguuuugcuucuuacagcuuacauuuuguugaucaacacuaucuuuaugagacuuauccauggugauauggguaacucuaguuuuuauuuaaacuuccaaauaguagccaaauuuggauggacacuaucagaccuccuauugguggacaaucaaguuguuuccaacuuuucacaauuacaagcaacauuuaaaugaauauuuuuauaaaugauucuuuagucauucuaaguccuugcuguuugaaaaguaugcuccacagaccaguagcaucgccaccauuuagggacuuguuagaaauggagcgucuuugauucugcugaaagagcacauuaaaaaaaaagagagagaaagaaagaaauggggaaucuuaugcuccacccagaccuacugaucagaaucugcauuuuaacaagauaggugauucauauccauauuaaaguuugagaagcauuauuuuaacguuuuuaccuaccuaggaguaguauuguuggguuauagaguuugcacaucuucaccucuauucugcuguauuguucuccaaagauacaccaguuuacacuccuguuagcagaguaugaguuccacauccucacugacacuuagcugacuuuaaaauuuuugcuaucuagaaaauaaaaaaugucauggaguuaaguaucuuaaauuuuuucuuuuuccuaucugguagguaugauuuucaauuugcauuuccuugauuauuuaguaagguuguguauagaccuuuuucagugcacuugcuuuauuuucugaaaaggagcuuuuaauuaaauuagguauuaaauguauuuuaaguguuacuugacuuuuauuuauauauauguauacacaaauguuacuuuacuuauauauauguauauguguauacauaaaauuaacauuaguagaaaucuuguuuaauagacuuaauuuuuucagcaccacaggcacaaucacgauguguguuucuucugacucuguuuccaagaagaauauuccuugaguggagaacagcaguuuacaacugggcccugcagagcucccaugaaguaauccgggcuaguuguguuaguggauuuuuuaucuuauugcagcagcagaauucuuguaacagaguucccaagauucuuauguauguacuaagauuuuaauuugaauauaucacucuauuggaaagaucauaauugucuggcuauguaugcaggguuguguuuauuguugaauauguaaagcaaauguugcuuuuaguuuuagaauuuaacauuuuuuccuucuaggcuuuguuuuaccaguacuuuugucccaaauuaagcaagacuauuuagaccacaaaauuaggcaagaaaguuuaguacuuuuucuuuuuuuuccccagagauaaagucaaagaugauucugacauugucaagaaagaauuugcuucuauacuuggucaacuugucuguacucuucacggcauguuuuaucugacaaguucuuuaacagaaccuuucucugaacacggacauguggaccucuucuguaggaacuugaaagccacuucucaacaugaauguucaucuucucaacuaaaagcuucugucugcaagccauuccuuuuccuacugaaaaaaaaaauaccuaguccaguaaaacuuggugagugauuaugacuuauuuaauacuuuaaaaccuauuuaagcucugcuuuucaaaucaguaaaagaauuagacugaagccuugaaaaauuacaggaaguuacaugcuuuauagauucagugcucaguauugauuaguuauaaaugggauaacugguauuagaucgcaucacaaaacugguaggagaggugauuuugggauuuuucgaauacucuugugauuugacagccuaaauggggcauaccugaugguuguuucaauauuguaagauucaauauuagauuaucuucuuuagugauaccagagaucgucuuaaugugcccccuguuacaaccuuggaccuugagaacuucaaauaguuaaauuacuuugcccaacugaggacuauagaguguaucuucuuggccacuuuccagugguaauggaguauaaauuuuuaugaaguaugagauuuauacaaauacuuagaagauccauuuguuuagguaguaaguugaaacuuguucugaaguuucaauagaaacuuucuauugaaagcaauagaaaguacucccuaaaucuuguaauguaagguuaacaauaaagcuaagauccccuugagaaaugugcuuuucuuuuuuucuuuuuuuuuuuuuccccgagacggaguuuugcucuuguugcccaggcugaaguacaauggcgccaucuuggcucacugcaaccucugccuccuggguucagacgauucuccugccccagccuccggaguagcugggauuacaggcgugugccaccaggccuggcaaauuuuugcauuuuuaguagagacaggguuucaccauguuggucaggcuagucuccaacuccugaccucagguaaucuacccacucuguccccccaaagugcugggguuacaggcaugagccaccaugcccggccuuucuucuuucuuuuuuuuuuuuuaagagacagggucuugcucugucacccaggcuagagugcaguggcgcaaucauggcucacugcagucugcauccuugaucucccaggcucaagugauccucccaccucagccucuugaguagcuggaaccauaguaugugccacuacacccagcuaauuuuuaaauuuuuuguagagagggaucucacuuuguugcccaggcuggucuuugaacuccuagcuucaagugauccucccaccuuggccucccagaguguugggauuacagguaugagucaccacuccuggccugcaauguguuuuuaaguuuaucuugguaacauauaauggucuacaaaaucugaaagagacuuguuauuuuauaacaauucuggaaauuauuuuagauuuaaauuauuuauaggcugagugcagugguucgcuccuuuaacaccagcacuucgggaggccgagacaggcggauugccugagcucagguguucgagaccagucugggcaacauggugaagccccaucucuacaaaaaauacaaaaauuagccaggcaugguggugcaugccuguggucccagcuacuugggaggcugaggugggaggaucacuugaaccugggaggucagggcugcaugcugcagugagccgugaucaugccacugcacuccagccugggugacagagcaagacccuauaucaaaaaaaaaaagugacauuuauuaaauauaaaguaauuuuaauuuauaaguauccauuuuaauuuccuaaaauucugugugcuauacauacuuaaauaugaaacauugacauuauaagagaacuuaggauucuucauggcauauuauuuguugacaauauuuuuacaguacaaccuugacauuuaauauguuaaauuagguauuguauacucuuguccuucagcuuucauagauaaucuacaucaucuuuguaagcaucuugauuuuagagaagaugaaacagauguaaaagcaguucuuggaacuuuauuaaauuuaauggaagauccagacaaagauguuagaguggcuuuuaguggaaauaucaagcacauauuggaauccuuggacucugaagauggauuuauaaaggagguugauaauuuuuguuuuuaacauuugaguuuacgucaaccuagcucuaaaaauuucuuuaaccaguuaauuuuauuguucuagcuuuuugucuuaagaaugaaggaagcauauacacaugcccaaauaucaagaaauaaugagcugaaggauaccuugauucuuacaacaggggauauuggaagguauacuuggcagcauuuguguucuuccuuauuuauuuuggccauucuccauuuuuauuugcuugcuguuaaaaauggugauaugauauuugugauauuauagacaaaaugugagucaacaugaauuuauuuguagauuuccguuuguuucugggauauuggagauacauauguguguguauguguguguguguguguguguguguuuguguauucauauguauguuguuuuuaauuuuagggccgcaaaaggagauuugguaccauuugcacucuuacacuuauugcauuguuuguuauccaagucagcaucugucucuggagcagcauacacagaaauuagagcucugguugcagcuaaaaguguuaaacugcaaaguuuuuucagccaguauaagaaacccaucugucagguaagagucagcguuugucuggacuauaggcaacagcaguacuuuuuaagaguuacaaaaaagaagaauauuuauacauguuuuauuuugcuugcuuuucuuuuuucuucaauuuauauuuuaaguucagggguauauugcagcauguagagguuugcuacauagguaaacgugucguggugguuugcugcacaggucaucucaucaccuagguauaagcccagcaugcauuaacuauuauuucugauacucucccuucccccaccccccuuacaggccccaguguguguuguuccccccauguguccauguguucucaucauucagcuccuacuuauaagugagaacuugugguguuugguuuucuguuccuguguuaguuugcugaggauaauggcuuccaauuccauucaugucccugcaaaggacaugaucuuguuccuuuuuauggcuguauaguauuccaugguguauauguaccauauuuucuucauccagucugucauugaugggcauuuagguuaacuccaugacuuugcuuuuuuuuuuuuuuuuuugagauggaguauugcucuguuguccaggcuggagugcaauggugcaaucucaguucacugcaaccuucaccucccagguucacgugauucuccugccucagccucccaaguaacugguauuauaggugccugccaccaugccuggcuaauuuuuguauuuuuaguagagaugagguuucaccauguuggccaaguuggucuugaacuccugaucucaagcaauccacccgucucagccucccaaagugcuaggauuacaggcaugagccacugcaccuggccaacuuugcuauuguaaauggugcugcagugaaccuacaugugcauguaucuuuacuauagaaugauuuauauuccuuuuuauauuccuuuggguauauacccaguagugggauugcugggucaaaugguauuucugccucuaggucuuugaggaguugccacacugucuuccacaaugguuuaacuaauuuagacucccaccaacgguauaaaagcauucccuuuucucggaaaccuugccaguaucuguuuuuugacuuuuuaauaauagccauucugcuggcgugagaugguaucucauuguaguuuugaucagugauguugagcuuuuuuucauguucguuggcuggcugcauguaugucuucuuuggagaagagucuguuuauguccuuugcccacuuuuguuuuuuucuuguaaauuuguuuaaguucuuuguagacucuggauauuagaccucugucagaugaauagauugcaaacauuuucuccuauucuguagguugucuguccacugugaugauaguuuauuuugcugugcagaagcucuugaguuuaaauagauccuauuugucaauuuuugcuuuguugaaauugcuuuugguguuuuugugaugaaaucuuugccugugccuauagccugagguauugccuagauuuucuucuagaguuuuuauaguuuugaguuuuacauuuaagucuuuaauccaucuugaguuaauuuuuguauauggugugaggaagggguccaguuuuaauuuucugcauauggcuagucaguucucccagcaccauuuauuaaauagagaguccuuucccuguugcuuguuuuugucagguuuguuaaagaucggaugguuguaggugugucaucuuauuucugaguucucuaaucuguuccauuugcuugcuuuuuaaaaguuuuauuuucuuuuuuauuuuaaacauuucuuagagaccaaauuucacucuguuguccaggcagcauacagugacauggaauggugugaucauaacucacugaaaccucuaacuccugggcuuagagauccucccacuuuagccucuugaguagcugggacuacaggugugcaccaccacaccuagcuaauuuuuauuuauuuaucuguagagaugggguuuuagagagagcagcccuauuuugcccaggcugcucucuaacuccuggccccaaaugauccucccacuucugccucugaaagugcugggauuacugucaugagccacugugccugguuuuaaaaagaaagcauugugcuugcuuuaaaaaauuauuguuaaggcugggcguggugacucacaccuguaaucucagcacuuugggaggccaaggugggcgcaucaccugaggucaggaguuugagaccagccuugcuagcauggugaaaccccaugucuacuaaaaauacaaaaauuaaccgggcauggggcgggcaucuguaaucccagcuacucaggaggcugaggcagaagaaucgccugaacccaggagguggcgguugcagugagccaagaucgcaccucugcauuccagccugagugacagagcaagacucugucuuuaaaaaaaaaaaauuauugucaaaaacgauguauuuuguuuauaguuuauuuacuauaacugaaaucuugccauuuuuauauuuuaggauauuggucugaagauacagguuauaaaugagggaggaaggaaaucaucuuauaaugguguauagacuuuuuagugauaguaaacuguuuuacaccuugauauuauguuauaugacacuuuguuuuaaauauauucaauuaauggcugaaaaguuagguuaugcuaaaauacugaauuuauuugugguauaauccuuagcaugauauucaaguuuuuuaacuaagucugauuaugucaucugugaaaggcagauuaugacauagucuaccucauuaagguuguuauaaaaauugaauggaccaauucagauaauguagaauacuauuugauacugcccucuaugguggcuuaaaaaguauuaguuaaaauuucuucuuugugugaaaacucacaauaaaaugguuuuugcucuaguuuuugguagaaucccuucacucuagucagaugacagcacuuccgaauacuccaugccagaaugcugacgugcgaaaacaagauguggcucaccagagagaaauggcuuuaaauacguugucugaaauugccaacguuuucgacuuuccugaucuuaaucguuuucuuacuguaaguugcaacauauaguucacuugagguuugcaauucaguauuuuguucauuccauucuagauuuugacuuugauaugagauuauugcuuaugcuguaaaacuuaaguuuaaguggauuugagucauuguucuuuaugguuagcuguccugaaaaguuaauacuaauugaauaaugcuaaucaauucaguuagcuauuugagcccuuaugucuuuggugcuaugauuuguuccguuggcaauucaaagucuaauaugaucauuucugcuucuaagguguuggaauaauaaaguauaaaauuauagugguauaaaugaucuacuauuacauauuuuauaguauggaguggacuccaaauauguguggcauuuaaaaauauuuuugcacauagcuuaugugaauauuuuuuucacccagacaaauguacuuuuugguaauuguugcauucuuuuucagaggacauuacaaguucuacuaccugaucuugcugccaaagcaagcccugcagcuucugcucucauucgaacuuuaggaaaacaauuaaaugucaaucguagagagauuuuaauaaacaacuucaaauauauuuuuucucauuuggucuguucuuguuccaaagaugaauuagaacgugcccuucauuaucugaagguaauugaauauuucuauauauuuuacuuuuuuauauaaauuagcauuauaggaaagauguaacauucuucuaggaaagagggugaguaaauuauagccuauccuagaagaauguaaguuuaaauguuguuauguuaaauaaucuuuguccugagagcauauuaaauagaauucuccuuuuguuuucuuugaucauuucaccauaaugggauaugauaggcauccuuucaugggagagguucucagccuauuucauuauaguacuuuucaguugauuggaguuauaaguugacugaugauacacacuuaauuauauccauaggaagaggcaaucaccuucaaauguaguauaaugucuauauuuuaguuacuugguguucugauuacaauuugguccagguuuuugguaguuuuuacauuuaaaauuauaaccugugcuucuuuuuuuuggugucauauuaacaaaauaucucugaggaauaugaaacuacaugggaacaggaaaacuaugagaaauaugcauauaacuuuacuguuuucucugauguuaauuuacuuaauuuguuucauaauauaugccagcagcacaucucuuuccacgagaguuagugaauaucaaauguauuuauucaucuugagaaaguauuauucgacuguauauuguggagauagaaugauaguaauaaguauuuauggaguauuuaauacaugucagaaauugagcuaaacaauugauauggaucauuucaugcaauccucacaguuacccaaugagauaaagguacucuuaauuuuuuuuuuuuuuuuuugugaugggaguuuugcucuguagcccaggcuggagugcaguggcacgaucucggcucacugcaaccuccaccuccuggguucaagcgauucuccugccuuagccuccugaguagcugggauuacaggugucugccaccaggccuggcuaauuuuuguauuuuuaguagaggugggguuucaccauguuggccaggcugguguccaacuccuggcugcaagugauccaccugccuuggccucccaaagugcuggaauuacaggugugaaccaacacgcccagccaaagguacuauuuuuuuguuuuguuucauagauaaggaacuaaggcagagugagguuagauuagguaacuuguccaagucagcauaucugauaaaugacagcuagaauuuaaacuaaagcaaucugaacagaaagacugcuauaagccacuauacuacauuuccucccaggguuguguguccccaauaaugaguugaugauauuauaagaccuuagagaaaacuaggacuugcuuuuuaauauuuuauuucuaaauaaaguuggaucacuucucuucauuacauauaauccaugggagaccuaccaggauagaauaagauuagaaucuuuuccaaugccuuuucuuaauaccuuuaauaaauccugucaucugggcuagagcuccugauguacuaauagcauguuaaaaucaguauacuuauuuccaggauauuaguaugaagaaaaaaauuuuuuuuaacaugucuuuggguuagaaugaaacagaaauugaacuggggagccuguugagacaagauuuccaaggauugcauaaugaauuauugcugcguauuggagaacacuaucaacagguuuuuaaugguuugucaauacuugccucauuugcauccagugaugauccauaucagggcccgagagauaucauaucaccugaacugaugguaaggaauauguucuaugagguuuuuuuguuuguuuuucuuccuuuugcagcuuaauuauaaaauugaagaaaucauauuuuuggucauuuucuggcugcuagccauuuguuuaaauuuuaaguugguauuuuuauuuugaaaaggcugauuuaaaucacguggucacaugcacaagaucaugaacacgagaucacguuuauuuucuuauagcauuaucacaacuuuguuuacauauuuacauauuuagggcauuaacaacauauauuagcauugaaaaauguggacuuuuaaguguuuuuaguagauuuuauuuuuucacugaauaaaaauguugaaguuuauuuuucucuacuacuuuuaaauuacauguauauuagaauauguuuguagcucuccucucacccugccccuccgacuacucuuuccuuaggucaacaaaugaaacuuuucaauucuaacuguaguuuaauccauuauuggauagaagggaaguuuggaaauauguucucuauuuuaaaucuuucccuaccauaaauuuguauuugaaaucacuuuacuguuuaucuaucuuaaaaaaauauguaaauccacagaauuaaauuauuauuuuuucuuucaacugcccuuauucuuguaacagacuuaaaggacuguuggcaaaauauuuuaacccauuuaugccagagguugcaaauuuuuuuugugaaaaaucagacuuuggugaugaccuugagcaguaggauauaaauaacuucuacaagcuuaccauuccaauaauggaauacuagacauaaguucauuaagagagauuuuuaucucugguuucucauuucccauucuagucuggcucuuuucucacuauuccaugaaauuccuuuugucaggaucaccaacagucuucugggcuauuaaaucucauagucacuucucuguccuaucuuauucaaccuuucaguaucauucaauacaauuggccauucuuuccugcguggcaucugugauaccacauugucuugauuuucuuuuuugcuucacuguucacucauauuuaggcuucuuuacuggcuuuuucccuguaaauuaucuacuuuauccucuaaauguuagaauaacucaggacuauguaacuggcucuuuuuucucagucaucauucucuccuuuaaugaucuucuuugaucuuuuucuuuaauaugaguuacauuuugauaauuuuuaguugaaauuucaguccagacugccucugagcuugguuuuauagguuagguccugggaggaaacagauggcauacacacaaacauuuacacagaaauaguuuaacaaaggggcuacuuuuagugacauggcaagguuaagggaaccagcaaggaauguuaaggaacccagguacuacaaaccacagaaaacuuaaugccccccuuaguucugggaaaggggaagaaauaguguuacuagaaccugauugagagccagaaccaugagggggguccucucauuguagaggaacauagccacugccagaacuaccucaaaacacagacagagcaggaaauaugaauaccauacucucuccuccuacccucuguucuagugguauuuccugcugacugaauucaguggaaagccagaggguaagggauccuaaguaaugcaguccggucagugucccagguacggagcagggcagaaggcggcagagaauggaccugaggaugacagaagauggcaaacagauauucaccuuuucaucaucucuacucucaugucuuauaagcaucucaaacaauuccaaauauaauauguucauuagaaaucuuuauuuucccuuucuaaucuguuuuucucccagucuuucccaucucaguaaugguaccgcuaucuaccaguugcaugagacaaaaccugagaagcauucgugagcccuccauuuccuuuauccuuuuauaauuaaugagcaaauccuaucaagucucuccaaaauauaucuuuucauuucugccaccaccacccuuacacaaauaaugaucaucuuucuugggacagcugugaacaucuccuaaugguucuguccuuucauucuucccucucuacaauuaauuauuuacacagccuuuggagugcucuuuuuacaaacucauaucguuccccugauuaaauuccuucaaugguuuucauugcccuuaacauaaaauaaaaucuguaaggcauacaugaucugccuaccuuucuacucucacaugguacaacucuuuucuuccuuucucccuauauuucaacaugguuuccuuuguguuucuuaaacaugccaaacuuuuuccugcuucgagaccuaggcccuggauggucucucugcuuggaauaaucuccuggaucuuucucauucuuuagauuucaagaguuuccugaguacccugucucgacucccuuaccacauuucuugucuaucacaggauuguguuuauuuucuuauagcauuaucacaacuuuguuuacauacuuacuacuuauuuagugucuuccauucaugcuagucuaccuuguaagcuaaugagagagaaugacucugcuuaucuuguacaccuguacccaguauaggauucuaggcauacauaauaaguauuuggugauagauaauauauugguagguagauaaagucaaauaauuguuugucugagugcaagaacuuuaauauuggaauguugacagagauugugugauccuuaucugcuuuuuauuuaagcaacauaggcuagaaccauacaauuagugaauuguggcuuaccaugccaaaguugagucucaaccuaaaucagaaguuugcagaacaaaaugcaauuuuagauuuuaaaaaccagaugauuuccugugcuaggcaagauaaagauuuauccugacaucuaaucuggagagacuuguaggauaccucacuccucucuauuauaugguagcacacacccuccuacccuuuucuugguaaugcauggaaccugaagauaccuaaaucagaugccucaacaucaagcagugcaacuuucuuauggaguucaaaaugcuuuaguugcuacucauucccagcucauuuuuuuuuuuuuuuuuuuuugcuccuuucuucugccuguacauaaagacaugaaacaaaagaauauucuucuuuacagacuggucacauucucaguuuguaguaauaugaacaaauugauuuaauacuuagcuauauacuaaguucuuagugaaugguaucuuuuuuuuuuuuuuuuuuuuuuuuuuuuggaggcaggauuuugcucugucacccaggcuggacugcaguggugcaaucucagcccacugcaaccucugccuccagcgcuuaagcaaucuucccaccucagccuccugaguagcugggaccacaggugcaugccaccaugcuuggcuaauuuuuuuuguagagaugggguuuugccauguuacccaggcuggucucaaacuucugagcucauguaauccaccugccucagccucccaaauugcugggauuauaggcgugagccaccacaccuagccaauaaaugguaucuuauuuagccuuuacaacaacucuaugcaguaggugguuuuauuauucacauuuuacaaacuuggaagaauuaaguaacuuauagaagaucacacauuaggaagugucaaaauuaagauucaaaccuagauuuggcugacuuaaagcccaugcccucuccuccaggaccuucucuuaagaaaguauuaacuuggccgagcacaguggcuuacaccugaaaucccagcacucugagaggccaaagcaggaggauugcuugagcccaggaguuugagaccagccugggcaacauggcgaaacuccaucucuacaaaaaauacaaaaaauuagcugggcgagguggugcgugccuguagucacagguacucaggaggcugagcugggaggauugcuugagucuaggagguugaggcugcagugagucgugauugugccacuacacuucagccuaggugacagagacccugucgagagaggaagaaaagaagaggagagaaaagaaaaaagagagagaaaggaggaaagaaagaaauagaaaggaaggaaggaacucuaagaaaaaagaggaggaaagaaagaaaaagaaagagggagggagggaggaaggaaggaaggaacccuguuuaaguaaaagaggaagaaagaaagagaaagagggaggaaggaagcaaaggagggaggaauggaagggaaggagggagggaggaaaggagggaggaagaaaggacggacggagggagggaggaaaggagggaggaagaagggauggacggagggagggaggaaaagagggacggagggaggaaggaaggaaggaaggaacuaaggaaggaacucuguuuacuucaggaaaccuaaagcgucauggaugaugauaucuagucugcaacuuuugaugcccauggucuugugccucuuuuccccuguuacuuccagggauauuauccccuaugucagaucauuauucugguagaauaccuuuuccuuaaucguacuuuucuaccauagcucuaaaugucauagaauaagggcagucccuugucuuucucuauucuuuucuuucuucuuuuccucuccaccccacaucccgacaugaauuagauccugaggaucccaccccaguucacuccaugauuaaaaaacucaucauuuucucauuguacuguacuguuuaaucauauuuuuucguggugacuauaaaucauuccuuuaaauacuacauguuucuuuaaauacuacaugugaagauauaugcuuuuggagaaacuuaauuaaccaaguguuuauuucuaauaugcuaaucuaguuagguaaaauauaaaugacauuaauuaaauaauuaaaaugucaacuuaagaaauucaaucuguauaaagcuuacauauuaucuguuuuuauuucuuaggcugauuauuuacaacccaaauuguugggcauuuuggcuuuuuuuaacaugcaguuacugagcucuaguguuggcauugaagauaagaaaaugguaaguggugauaguuccagagugcuaagauagaauucauacagaauauagauaaauucugcaucuagcuacaaacauucaaagaugagaaauaaccaaauaugacauucucuauugcugaagaacucauauacguuuuuugggagucuaaaaauuggaauuguauucguuucauuucuuuaguuuaggagggauagaacacccaacccaaagugacuaaaaggaacuuguggcuguguuacuaaaagcguaaggaugauguagcuuuaggcauaacuugauuuuggacucaaaaaaguucucagagucagucuuuuggcucagauucaucuggguuggcucuguacuuaagagccaguuaaugaccucaauggcuucaagcucacgucaucacaacaucuaguccagcauuugaagagagagacuagcaaucacugaaagcucaaacaaaaguugcaucauugagucuccuugguuuagauuggucuggugugggucauggcucaugguguuuuugaacaccagaaaucuuagguuauuauaauguaaagcaacuuuauguuuaaaugcuugugccacagugaaguuucauuaugacugcugcaacaguuggccaccguuggaaauuuucguccuauaaauuggaguaaaauuuuagauauugauaaaauuucucuuucuguugcuuuccaccucugcagucaguaagauuacaauaaaaacaaacaaaaaacaccuacgaauggaagcuuuuauuucaguguauacucuccccuccuuuuuuuuuuauuaaggagccaagaaagacauauguuaccauauuaaauuuugcaaauuucagcaaccaaugccuguucuuuuggugucaacuaguaaauucaaucccccaaccaacuacuauuccaucuacauggcuucuuuccuauuguuuccccaauugcuauucuaagggagagaaucaccuugaaucuaagaaaacuacaguuugucuuguaaaccauaaauaacuaaaauguuuuggcauauaaagucgaccagaguuucuuuaccccuucauuauaaacuggagcugcugauaacaggucugguucuguguuuuucauguguuucauuuucugaguguaucauuaauuauuuguuuuacuaaauucaggacaucuugaauuuaauaucauuaggacaaaaauuuccuuaacuacugauuacuaggaaguauuccauuuacuacaaaaauuguuauauggucucaaauuuaaaugauuuuaauucaguuuguuuuauauauguguauggcaguuugggauagauaugaaagaaauuaaacaauaugcauuauaccuuuaauaaauuagaaauuguacuguucuagaugaauacugggcuaaaauaacaaaucaccuucaagggaaaaaacaaaaaagaacucaacuuguauuuuucaaauuuauaauuaccacauaagacauaagcaauuggacaaaacaaacuggccaacauuuauucaaucuuuuguauuaucugagaauagaugacacccugauacugggugggaagcacuuguccuuagggcucaucugcuucuggcagcauguuuauaagcuuuacucugaagcacuacuuaacucuauaggccuugaacaguuugaugucuuugaugaaguuaaugggacccaaacaugucaguucugugagggugaagaugaugaccacacugagaacuggccuucgauucaaggaugauuuuccugaauuguguugcagguaaaugacugccugaguuuauuaauuuuuuuuuuuuuugcauuuuccaguagcacuaacuugaauucuuaucucuuugagggaaauuggguucaaauaauaaauaagguagaaagacuauuuauuuguauuuaaaauagaacauauuuacuucuuuuaaaacauuuuacuauggaagucuuuuaacauacugggaaauagaagaguuaucaaugaaccuacauaccuauuucccaacuuuagcaguuaucaacauugcuaguuuuuuuuaauccacuucuaccuuuuugauuguugguugggguauuuuagagaagaucccagaaucuuaucauugugcuuguaaauacuuuagauguaucuaacggaugaggacauuuaaaaaauaaccuucaugaauuauuauacuuagcaggauuaauagaaauaucuaaucuaaaacucaguccuuagucacauuuccuccaguugucucaaagguauuuuucccaaagacauuguauauauuauguuguauaugaccagagauguuuguauguaucagagauguuuuuccagagauguuuguauguaucauaguuucuugaauuagacuauaaaugaaguuuacauauguguauuugguugccuggcuccuuaagugucucuuguaaacagccucaucccuuaaauucucuacucacacauuuuacuuauuuuaggcuguuaagauuuuaggauguuggauuuggcgaauagcuaauuuaacuuuucccucuauuuuuucuuuccucccugucuuuucuauaaauggguacuuagauauagaugcuugauuagauuuagguucaauuuauuaugauaacauaccucauaggugaggcuuugugcuucucuuguggcacaguaugagccacauaauaauaucugguuguccacuuuuaguaaugguaagauuagacaguagguuuuaucaaccugaaucccuuuauuauaaaauuccccacuaaucuuucaucugaugauuuuagcauuaauuaaugaucauugccuaaguccauuauuucauugcaguugaugaaauaaugauuuucuaauuuuauuauuccuucuguauuuacuaggugggauucuucuuaaaacaaaauuccucauaaaauuuggcuagccgggcaugauugugcguaucuguagucccagcugcuuaggaagcugagguggaaggaucauuugaggccaggaguuugagucuagccugggcaacauagcaggaccuugucuuuaaaagcaaaacaaccauaguucauauaaagcaguucauaaauacuugaauauuucccuuuaguuaaucaauuuaggaauauagguuugugcuguagcaaccuccagugaaguuuuuuuaauaucauuuugauaacguagauuuuuauaaguuugauuauuuuuuauccauuaaagucacuauccuuuuuuauugcugaaauugucccaucuuaagcaaguagaaaucccuucaaguuggcaucuaugaguuuugauaugaccucuauuaaucucuuauagauucucugcuuucuggcaugacaagaugaccugggcuuaucuugaacauuuccugccucugacucaaaauuagugauuucuucaaggaaaccuggcucugguuccuuugagcccagauuaauuccaagcauaggcacucuuugggccuacugucauugcuucuaagucuuaagugaauguagcuacuagaaaauuuuuauaaagaauagguuuuagaaucacgugaaguacuuauuuucugugugcaugugcuaccaauuuaacauuuaguuagguucacuuguuucaguuucuuuaaaacuuuuaaggguugcuuuuucccucuauuuuauuuaauuuaaaaguuauauaaaacauuugcauagucccaaauucaaaucuguguaacaaauuauagucagaaaucuagauuccaauuucgaccucuacagauaucuauuuuuauuaauuuuuguauauccacccucuguaaaagaauaaguaaaugcacacacacauacuuuuuuuuuauuauuaauucugccccaaacacuguuuuucaccuugcuuuuuugacuucacauaauuuggacaucacuuuauuugaauauauagcacugaucuuuauuccauguuuaaagcugccuuuuaaucuauuguuuguauauaucaugugucuucaacuaauuacugauugauagagcuuuacaaauaauaaaaguaauuggacuucauuucuauuuguuuuuucacauagagcuugggacugcuuuguucgcugccuggaucaugcuugucugggcucccuucucagucauguaauaguagcuuuguuaccucuuauacacauccagccuaaagaaacugcagcuaucuuccacuaccucauaauugaaaacagguauuguaacugaaauuaauaguaaaauaauaacuuuuuaaacuguauuuuuaugucucaaaauuacugaugguaauguggaaacugucacuuuuuugaauuucaggguuuaucaauaaacaaaaguaauuggcauguaauuacauauugaaaugaugcuauuucaguuguggcauugcuucuauuauaauuauuuccaaagcucacuaauaggucaccaguuaaaaauuacuuuucauuaauucuguaaauguguaaccuaauuuaccuuucuuuucacagucaaaaggcagauaguugaauagcaugagaaagguuaggagagauaccuacuuucugcagcuuaccuuaguugaaacccuuauuaccucauugcguuaagcuuugaaccagccucucuuccuuuaagcuuucaucacuuuucuugauauuguuacuagaacuguguuuuaaaaauaucucuuuauuggugucauuccagcauacaaaggcauucugagauucuccauuuccuaauugauaaauuccaaauugcuuagcuugauauugaaggcuuucuaaaaauguggccacagacuauuucuuacuaucuucccccauaauuuuucaaaacaggcauuaggcuauagccaguguggauuacuauugacagaacaugcauuauucuuucccauuuguauuuuugauucaggcugcuuuuuagacugggaugucuuuuuauauauuuaauuuuuuuucugugauuuuacuuaauguuguauauaaucauuccuuugcuugugaaaaguugggauugaaguacuacuuauuuaccuacucacccauaugcuauugcuggucccuuuagucaguugcaguaacugucuaaugagggagaaaucauagaagaaggaaaaguuaauguguuuuuauuuaguuaaaauacuuuuauuuuugauauuuuuauauuuugugcaugauaaaacaacaaaaucacuaauuuagauuuugggacuacuuuucaaguaccuuuuaaauuuuuuuguacauagucaugucuuugcuguuuauugcagaagugucauuucucuaccuuucucauaaucauaagaaaaauccugaccaggcaugguggcucaugccaacaauaccaauacuuugggaggacaaggcuggaggauugcuugaggccaggagccugggcaacauagugagaaccucaucucuacaaaaaauacagaaacauuuaaaaaaaaaaaagcaaaaagagccuguaauccuagcuacugcaggcugaggcaggaagauuguuugaacccaggaguuugaggcugcagugaguuaugaucaugcugcaagauagaagaccuuaagcuugcugaaugaaggcacuacuuuggcuuuguuuauuguuccauccccagugacuagcagagugcuuagcauguaguagcacauaguaguuauuuaauauauauuuauugcaugaguuaaugaagacuaggauuuagaaaugcuuauauuuggacccagaaagauuagagcauuuauuauauuagaaggaaauuaaaaauuauagcccugacaaggauuauuuauguauuuuuuucuauaauucuucaugauaauuuguauauugagguagucuuugucugucuauugcuacauuccaaaucacuccaaaaccuaguaucuuaaaacaaugagcauuuuuauuugcucauaauuuugcaaucuggacugugcucagcuggucaguucuacuggucuuacaaguggucacugauguggccacauucagggggcagguagacugggcugggcccucucucauuccguguagucucacagucugucucucuguaccacggucuguccauguugguggcaacacuucuuacguagugacucagggcucuccagaacacacaaauggaaacuugcaggcauuuuuaacaggccccaaauuggcacaguauaucuucugccacagucuauuugcuaaagcaagucacacacucagcccagcuugaagaggaagggacuguauauauggguuuguaugcugagaagcaugguuuauuguagcacuauuauagagugauuuucauagcuuuggucauuuuccacuaauaauuuagcugagcaucuuagacauaguuagaaaauacuuugcagcucaguaaucaacuagcacuuuuaauuaugaauuaaauuggccuuaguuucaacuuuuacuuuacauuuuuuuaguauucauauucuuggcaaauaauucuuuuuauuccaacuaacuauuagggaugcugugcaagauuuucuucaugaaauauauuuuuuaccugaucauccagaauuaaaaaagauaaaagccguucuccaggaauacagaaagguauuuaauuuuuaauuugugguuuaggagaucauuaauacagaauuguucccaaguuccaauacaugaaauaaagauccuuuaggaucauaucuagggauaauauaguccuauucugauagcuaauuccuggugaguagauaaugcuaccaugaauccaugacuuuuggagggaaguuuuagcauuuagauuaaauauguaacaccauuagauagaacagagagcaaaaaauacaauucuuaugccuuuacuacccagaccaaaguguccuuacuuauugucccaaaaagaagcgcuaccacagcggcacacccuaagagaagaaaggaaagcugugggaugauucuaguuuuguugugcuacaaaccaugauauagaaaugucagaugugaaugauuccugagauuuagaaggggaauaauuuauaauuccagcaucuuaaaucuuagugagcucucuaaaauuaugaagauguuaguggugauuucauagaacuucuggguagaaagugggacaccugaccuuaggugucaccuuggguagugaaaggaauugaauuaccuauauaauccauagaccugguucaaagcuauuauguagcccuuuguaaauuaagggaaacuuguacuuccugucaagaaguacuuauuuuagagaaguaaauucuuacuuaguugggauaaaauuuuucuccaggucuaacaguuuuacaaugaaaucccuuucccucagaauuacuaaaaaugauuugugcuguacaaaggaaggaauggaaauuucauuacuuuaaaaaauugguuugguauaguuuaaugguaacuauauagagaauucaggccuuuggaaaugguuguuaaaauaguugauuaauaaguucugucucucugugcuuuguauauaggagaccucugagagcacugaucuucagacaacucuucagcucucuaugaaggccauucaacaugaaaaugucgauguucguauucaugcucuuacaagcuugaaggaaaccuuguauaaaaaucagguaugcuaauaugauauaauuaaaaauguauaacaaagaaagauuggaggcuuaaagaaaagaugacaaaaugacauuuuuguuugagauuuagugaaagaagaaauuuuuauuuuaccugaauuaucagaucugacugagaauuaggaauccaugagaugcccuuugagcuugaaucuuagggauuugcaguuuuuguuguuuuugaaggaucaugauuugaugguuauauuuuagguuacugcaucuucguaaguaaacauguauauaauuguauaauacagcagcaguuuauguaagucuucucacauauuuccuauggauauaugucauaugaaaugucagcaauuuuacuauuguacauuuugacugaauuaacguuaguuuuaaugaagcuaaaucuuuaaguuuacuuuuucaaggggugagugaacuuuauucuuuucuuuggcaacauaauguagauuaucccuaaacuugaugauagugagaacugguauuuaaaauaccagaucacuguauaugaauaaauuggaaaaaauuuaacggaauuacucauuuuugcauaucuagaacccauaugguaagauaugagagccuaagacccucaugaauuuugggauuaccauucuauaauggaaggguuauauuuccuuccauuaauagaagcaagcacuuacuuaggacaaaagauauacgugaugguaaugagcacauuuuucuggggcagugaguuuguauaaccaauguggguagcagccaguguggagaugaucccaacagaggggaggagccuugaaucuccucuagguuaaguguugugccuuccugacuauagaugugcauuaucaacguuacagccucuauuccugcucuaaacuacaaugaaacuacccugugcuugccccuagccccauaccuuuaccugguuuucagguaacucaaaggacuuuuagccuuuuaauuuaauacagagauuuaugaaucacaaagguuuucuccucuuugcauagagguuuucuaguuuagguuauuuccaagcagauggcacagucauugucuaacauaaggaaacuucaccucaaucaucacuuccuagauauaaauaacuaaaucugagaauucaagaagauuucuuacagucuuaaggaaagcugcagcugccucacuuugccuccuggaucacagaagauaaaucauauguggcaacuuccuuacaggauuccuucaauguaaagccccaaugcuaauagauuaccuagacagaauaagaagggaaguguacuuguaggagucuugaguacucugauuaagauauaauagccguauauuauuaugggauuuuuuuaaaguaaguauuuaauguaguuuagcaucuauaacuggauaaauuuauggcaggcugguaagaaaaacuaaaggcaaggaagauuggaagauccaugaggagguaagaaaagaauaaagauccagaaacacgucuuccuaaccauacuccagcaggcacuggcccaaaacaccuaggaauaaagagagaaggaaauggguuuuuucccaacuguggcaagaagauagcauuaaaguugaauacaauugaauuaagacuuccaauaguacuguccaaaggaccuuucugugaggaugaaaauauucuauaucuauacucuucagcaguagccacuagccacauguggcucucuugagcacuugaaauauaugcucaaacauuauguucugaguaacagaauuuuuaauucuauuuaauuuugcuaauuuaaauuuauuuacuuauuuacuuuuagaggcagggucucuccaguacaggggugugaugauagcucccugcagccugaaacuccugggcucaagcaauucucccacuucagccuccugaguagcuaagauuacaggugugugccaccaugcucaccuaauuuuuuuuuuuaagagauggggucuugcuauguugcccaggcuggucuugaacuccuggccucaugcaguccccuugccugggccucugggaguacugguauuacaggugugagccacucuaccuggccuaauuuaaauuuaaauagccacauguggauaguagcuauuguauuggacagugcagcucuacaaguugguugaaccuacaggaauaccaccagagcaugaaacuggcauaagauaagaggaugagaggccagagucuuuguagucaguacucuuaagaguccaugagacaacagaugcaaaagauucuguuuuagaauuuaaaauuuagccacagggagaggaaaagauacuuuaagaguggauugaaaggagguuuuuauuuaaaaauacaccugaaguugugguaggaguggcuaaacaaaugauuggguguaauguagcaacaaagcaaauuccaagagguggugauaggaaaguuaauaagaugaucgcugguauagcauuagauacuuaacuauuuuuuauggaaugacccugcaaaagcccuguacugauggguagucccagacagucauugacauugaagagaugacaccuucuacuuauuuuuaaggaggaauauauauuuuugaaggaauagaagacuucuaagcucaguggauggcagaaaaugauuucuauguagaaaagucagacuagagaucaaauuaagaaaccauauaauugguuucugaagauugauacuagucaggaauccauuugauaaaaucccaaaaagauaacuuuguaagaagccaaaauaaacuuuuauggcaaugcagaauucuaauaaaaugacauuuacuaacguuuacacauaagagaagaggcuauugaaaauaaaacugggagguggagccaagauggccaaauaggaacagcuccagucuacagcucccagcgugagugacgcagaagaugggugauuucugcauuuccaacugagguaccggguucaucucacuggggagugucagacagugggugcaggacagugggugcagcccaccgagcaugagccgaagcagggcacuucucaaaagaagacauuuaugcagccaaaaaacacaugaaaaaaugcucauccucacuggccaucagagaaaugcaaaucaaaaccacaaugagauaccaucucacaccaguuagaauggugaucauuaaaaagucaggaaacaacaggugcuggagaggauguggggaaauaggaacacuuuuacacuguuggugggacuguaaacuaguucaaccauuguggaagucaguguggcgauuccucagggaucuagaacuagaaauaccauuugacccagccaucccauuacuggguauauacccaaaggauuauaaaacaugcugcuauaaagacacaugcacacauauguuuauugcagcacuauucacaauagcaaagacuuggaaccaacccaaauguccaagaaugauagacugaauuaagaaaauguggcacauauaccccauggaauacuaugcagccauaaaaaaggaugaguucauguccuuuguagggacauggaugaagcuggaaaccaucauucucagcaaacuauuucaaggacaaaaaacgaaacaccgcauguucucacucauuggugggaauugaacaaugagaacacauggacacaggaaggggaacaucacacacuggggccuguuguggggugaggggcugggggagggauagcauuaggagauauaccuaauguuaaaugacgaguuaaugggugcagcacaccaacauggcacauguauacauauguaacaaaccugcacguuguguacaaguacccuaaaacuuaaaguauaauaauaaaaauaaaauaaaauaaaauaaaauaaaacugcuagagacuuucagguugucuuaggauaaugguggaugccuacaucugaauuucuguguagccccugaaauaucauaaagagugucaagcagagcaauugaaaccacacauaauuuacaccuucaacagaacuuugagacagaauauuaugaacuucaaauuacuuguaacuaacagagauaucuguggagcucauaucuuaaccuuguaugguguugagagcggguacguucugaugagacuguauaaaaaaagaagaaaaugaagaauaggaacuaagaauugauggagcaaagagaaaaucaccaacagaaagagagucauacucuuaagugcaacauuacugaaaauaaguccaggaugugguaugucagacuacuggcuacagggaagguacuugaaaguaugcccaacguuuguagucucugaaaaucaguuucuugggaguaguaaaagaagaggagaggagaggcacucuucagagacuauggcauaaacagaaagaagaaaguaagagggagaauuuuaaggguccugcagaaguaaaagaaauguacaaaaucagagaugaaccaaauccucccccugcuaccagaaaaagaaaaaaaagcuauucaugaagaaaacugcacuucacuaugcugacguggauacucaugaaagagaaauccugaagccacuacagaaugcuuacugcagauagcuguuauggaggguuuucuaguuuagaaauuucacaauauguguagaaaaaauauauguaugcaagguuccuguaagacaaaaauagaaaaugaaaauaaagucugugaauugaugacaguuccuccucaaaaccaaccauaacauggaagaagauugaacuuagcaguauaacuuuaauugaauauuuuaaacaaucauuuucagauauaaaaaaaguugcaugaaaaauuuaaaaaacaagagaaauaaaaaccaagaugaaacgagggugauugaacuuaggaaagaaauugaaaugaagauuaaauuacaagaacuacaggggagaauauauuugacuaaacauuuagcaaggggcauugaauaaagguauaaaaaacagaagaaaaaugagauaaaggaguaaaauagauaaaggaguaaaaaggaguaaaaagaaaaaguaguugaaauggaagauuggcaaagauuucaccugcaaauaauugaugucucugaagaauaaaaccaaaacaagagaacagaauuaauauuuaaaauuauaauccaagaaagcuuucuggaaauaaaagaccuaaucuacauauugaaaagacuuguauccuggagaaaauugacccaggauaauuaacucugagacauauccuagacuuuaauaauaaaaagucuucaaagcuuccuggccaaaaaauuuuuuuucaaaaaauuacuugcaaggagaaaaaaaaguagauugguaucagaauucucaguaggaauguacagagugggccuagaaaauagcagcauuuuuuuaaaaugucaaaaaaugucauaaaguaugagucaagaaagagucaagcuguccuuagaguaucauguaugagaacacgguuuuaaaccuacaagaauugaaguaauaugguuuucacaagugaucccuuccuaagagauguauuagaggaugagcuucauuaagucaagagaugacugggcagacuuuggcaaaaggucugaugguuacuguuuauguauuuaacgaaauauauaagacuaaaacaacaauagggcaagugugggauaauuauauguaaauguuauauucuaauaaacuagaaauaaugcaauuuuuuuaaaugagagaagggggagaguaaggaguaaguaagauaagcucaguaauuguugcauaggcaauaacuggaagucaaaauauaccauuuuacaccggcaaacuaguuauagaaagucaaauaaggaaaagagggaguguagguauuucaaaaaauuaccuuaauuuuuauuuuaccuuuaagguaaauaauauuucaccuuuaauuaauauuaaagguauuaauauauuggauaggcugggcacgguagcucacgccuguaaucccagcacuuugggaggccaaggcaggcagaucacgaggucaggaguucaagaccagccugaccaacauggugaaacgcugucucuacuaaaaauacaaaaauuaaccaggcaugauggcgcaccuguaaucccagcugcucaggaggcugaagcaggagaaucgcuugaacccgggaggcagagguugcagugagccgagauugcgccacugcacuccagccugggugacacagugagacucugccucaaaaaaaaaaaaaaaaaaaaaauauauauauauauauauauauauaugauaauuccagaacaaaaguauaaacugucauccuuacccaaauaaaugauuuuuuaaacacgaaacaggauagagggaagaaagcacuaauuauaguauacuguauuauaauuauaauccauuguauuauaauaaaaaaucugacagaauuguagccaagcaucugagucacauuaauaagugugaacaaccuuaaaauuaaaaaauuuacaaauuggcuuacaaaguaagaaacaacucucuaccacaugcaagauacguaccuaaagugauucagaaaggccaaaaauaaagggauaagcaaaaauuauccagauaaguggaaaguauaagaaagcaggaauucucauucugccaccaaacaaaauagaacugaagcugaaaagcauuaaauaugaccaaaauggauacuuuuuaaugcuuaaugccauaauucauaaggaagauuuaauaguuaugaauaugcuccaaauaacacaccagccaccuugauaaagccaaaauaagaagcuuaagaagauauauauagaaacucaaucagaggagacuaccauguuauucucaguauaaaauaaguuaguagauaaauacguagaagaucuaaauaacauaauaaaguagcuauugugaauauaugucagacguuacaccuugauaauagaagcauacuuuaaagagcagauagaacauucauaaaaauugauuauuguauuaguuggaucuuuguguuaguuugcuagggcugcuauaacaaaguacuacaaacugaaugacuuuaaacaacagaaacagaaauuuauugucucacagcucccaugggcuagaaguuugagaucaaggugguggcaggguugguuccuuuugagagcuucuggugguuugcuggcaaccuuugguauucuugaauaaacagauccauagagauagaaaguagauuaaugguugccuaggguuaggagguuugggggaaauggggagugauugcugauggguacagauuccuuuugagaugguaaaaauguucugaaauuaaauagaagugaugguugcacuugugauauacuucauuauacuaaaacuugugaauauacuaaagaccauucauuuguacaccuuagaagaguuaauuuuauaguaugugaaacaaauauuuuauuaaaacuauuuaagaaaagauaguacaggaagaaaauaauaaaaauaaaagcagaaauauagagaacagaaagcaguaaaauuaauuaaugaguaaaaaugcuagcaaaaaacuagcgaaauugguaaaugucaaauauguaaauaauaaacuguugaaacauagaagguauuuaaaaaucacaagagacuacuuuguacccuuuuacacaaauaaauuuguaaacauguauacuuuuccuggaauauauaguguaucaaaaugaacucuagcugaaauagaaagcuuaaaagauuaguuucuguaggagaaauagagaauauuauaaaagaacuucauccauaggaaagcaccaggcccagauaaggggauuuuuaaaucaaauuuucacaaacuaaauagucucagugguguuuaaauuguccuggaguauaggaaaugaaagaaaacuuccauuuuuaaaaaagcggcaauauauaacaguguucaguagaccgaaaaaagauagcaugaaacaaaaaauuaaagauuaucauauuaauaucaguguaaaaauuuauaaaugaaauauuaucaaacaaaucaauuucacauuaagaaaacaccccaugcuggguguaguggcucaugccuguaaucccaacacuuugggaggccaaggcagauggauugcuugagcccaaggguucgagaccagccugagcaauauagcaagaccccaucucuacaaaaaauacaaaaauuagccaggcaugguggcacaugccuaaaguccaagcuacuuggagguugaggugggaggaucaccuuggccuggggaguuugaggcugcagugagccaagaucaugccacugcauuccagccagggcaacagagcgggacccugucucaaaaaaaaaaaaacaaaaacaaacccacaauaccccaugaccaguugcauuuuauuccaguauugcaaagaugguuaauacuuagcaauccacgaauguaauucacuauauuaauagaucuaaagagaaaaucaugcuauuauuuccauagaugccgaauagacuuugacacauuucaucaccuacuucaaaugaaaacacucaagaaaacagaaauugaugaauauuaucuuaauguauauguguacauauauguaugcauguuuauauauguacuauguauauauauacauaguacauauauacacauacuuaaugggaaacaagaaacauucccacugaaagcaagguuuccuauuaucugcacuauuuagcguucacuuggagguauuggcuaaggaauuuagggaaaaaagcaaucagacauaaaaguuggaaaagauguaaaacuauauuuacagaugauaugauaaucagagacauaagaauuggaaaagauguaaaauuaucuccauuucuuaugcuaauauacuucggaaauuauagagaauuacugauaaaacuaacuugaccacagaugaauucaguaaaauaggggauauaaaauuaacauaaaaauuaauaauuuucauaugacaagugguaacuagguagaaauuuuuuuggaauaccccauuuacaauagcaacaggaaaacaauauaguugaguauaaacuuaacaagaaaugcauacaccaacaaaagaaaaauuuuaaaaugcuucugaaagacacaaaaggguaauagauuuaacuaaauggaaaccaucacuguuuuagucuguuugcuuugcuguaaaggaauuauaguaaauuacccugaggcuggguaauuuauuaaaaagaagagguuuauuuggcuuaugguucugcaaccuauacaagaagcauggugccagcaucugcuucuggugaggguuucagcaagccugagccuuuacucauagccaaaggggaaggggaguuggcauaucacauggugagagagggagcaagaaagcaaugggaggagugccauacucucaaauaaccaguuaucacuugaacuaauggaguccagcucacaccugaacuaauagagaaagaacucacuuauuaucacagggauggcaccaagccauucaugagggauccacccaugugacccaaacaccugccaccagaucucaccuccaacacugggggucacauuucaauaugagauuuggaauggacagauaccuaagcuauaucaaucccuuauuauuggguagguugauguuauaacgauuucaguucuccuuagguuaauuaauggaaugcaaucccaaugaaaaugucaccaaaguuguuuuuuuuuuaacuguaggagguuuauaauaaugcucauauggaaaaauaaaacauguaaaaaauagcuaguaaacucccccuguaaaaaaaaagguuaugagaauauaguagcccaaccaaacauuaauauacuuuguagccacuacaguuauaacaaagagguaacuaguauaugaauaaccagaccagugggaaacaauaggaggucuagaaauagacccaaguacauauggacauuuaguauaugauaaaaagugacacuucuuaucugaguuuuacuuuuaacugauuaccaggguguguauguguggggguggggaggcggucuuuacagcugaauuaaccuguaauguuauuuaagaaaucagcuauugaagauucuggauaagauuaaaugucuuuucguuuuucuuuugaaauguauuacaguaauuuguauuacucauuacaguucuaacauggaguuugagaugcuccuauacacuugacuugugcuagaaagaaaauaauauaaaugaaguagcuuuaaagugaucacacaagugcaaggucuaaaucuucacuggcuugagaauuguuucuucuuacuuaacauuuuauucauuacagcauccugaagagauagcugaaaaaagacuauuugaauugacauauuuaucauuaggcuaccucuuucuuccucccucuuuuccauccucacagaacccuuuuuuauaucuuuuuuccuucuuuacuaguuguuauacacuuuucaaacuucuuguuuuaaccuaauaguugcuccuccacuuaucuacugaaauaucuguccacuguccuuuaaaaguuacucuguguuuuuucuuauucauugcuucuuugccguacaaguauauuuguuauuguacauaucauaugauauuuuaguuauuugucuguuuuccucuuagacugugaacuuguuaagacuuguuuuacugauuuuuuguauauugauaaaaugcacaguaacugcuuguuuaauggauuaaugaucaaagacuuucagacauuuaaugauucuaauuguacaggacauauuguugaacuauauuaugugaacucaucaaaaacuagcugaaaaaauugcagauacagaaauuuaauuuugucaauauuuauguuagauauuccuuaauauuuuuaagcuuccuagcucaggaaaacauacuaguuuguagaaauuacguauaaauuuucuuucuacuuuuauuuuaggaaaaacugauaaaguaugcaacagacagugaaacaguagaaccuauuaucucacaguuggugacagugcuuuugaaagguugccaagaugcaaacucucaagcucgguugcucuguggggaauguuuaggggaauugggggcgauagauccaggucgauuagauuucucaacaacugaaacucaaggaaaagauuuuacauuugugguaaguaguggaaauuuggaaugacaaaagaguucucuguccuauugagguuuauauauuucauuuacaaagaacuauucagcuuauccuuaauaaaagcuucaccuagaaccagacaaucaguuaacuucugaguuuauuucuuuuacuauugcagaaaccuuuagccaaaagcaauaaaguuugaaccccaucuaggguguuauauucuuguaaauaaagcuuccuaauauaauaaugacaauacuuaaagccuaaucaauuauuuaaauauuacuuuuuaaacauuauugcuaguguuuccauggauaacuaguuuccaggauauuacaguaguaauguuuuguagucaaaugaguuugggaacuccauauagaacaaaauuaaaugugaccuuuuaaaaaaaaugugacuuuuaauguaucugugugcauugugaaucucuaagacuauaucuccaagaguuauacuauaugcguauauuaaaauuauuccuuagagguucucagaugacucuugggcucuacagaaugcaacguaggagaugcuauguauacauuuuguguuuuuuuuuggacggagucucgcucugucacccaggcuggagugcaguggugcgaucuuggcuuacugcaaccucugccuccuggauucaagcgauuguccugccucagccucccgaguagcugggauuacaggcgugcaccaccacgccuggcuaauuuuuguauuuuuaguagagaugggcuuucaccauauuggccagucuggucuugaacuccugaccucaugauccgcucuccuuggccucccagaaugcuggaauuagagccauuagccaccaugccuggccuacauuuugcuuuuuaaggguuaaaaaacaaacaaugcaaauugucagagauaugcaaaaguugaauaauuuuuuguacaccuuagaaauagccuaaaaagcuuuacauuuuggcuuuuuagcuacagauuauauuguagucuugauaccaaacuuaguuugaaccucacugucuuuuccuuugucuaaguuaaauucacuuacgcaguuaaguuaaauucaccauggaaaaagcaguacaccuaagaaaauuuauagcaguuauccuggaauuuucuuuuuuuuuuuucugauugagacuggaguagaagauucaagcuuugccuauggauuauugauggagcuaacaagagcuuaccuugcguaugcugauaauagccgagcucaagauucagcugccuaugccauucagguaagaguggauauagucauuacuggcuuuaaauuguuuaauucaaauaagaacguuguaaauucuauacuugugaaacuccuuuuuguuuuaauucucacuuuuaucaaaguuauacaaguucaugauaaacauuuuagaguacagaagcauaccucuuaaccaauuauuauagguauaguuacuuucaaaauuuuuguauguauauacaaauauauacuacugccucagcuuugugacuuaaaugaguuacuuaaaucauucuaggcauugaaauaaauguccuaaggauguucacagcucuaaaacuauaaaauucuguuuauuuuucuauguacaagcauaacucagagauaguagggguucaguuccagaccaccacaauaaagcaaguaucucuauaaagcaaguuacaugaauucuucaguuucccagugcauauuaacauuauguuuacacuauacuauagucugucaggugugcaauagcauuaugucuaaaaaccaauguaaaugccuuuauuuaaaaaauacuuuguuacuaaaaaaugcuaaccaucuucugagccuucgcaagucauaaugguuuugcugguggaagauuuugccucaauguugaugaugcugauuaauuaccguggugguugcugaagguuggaauggcuguggcaauuucuuaaaaaaaucagacaacgaaguuugccacaucaguugccuuucaugaaagguuucucuguagccugugaugcuguuugauaccauuuuccccacaguagaacuucuuucaaaauuugaaugaguccucucaaaccuugccacugcuuaaucaacuaaguuuauguaauguucuaaauccuucguugucaccugaacaguguucacagcauuuugaguggaaccacaguagauuccaucuccagaaaccacuuucuuugcuuauaaaaagcaacuccucguccauucagguuuuaucaugagaaggcaguaauucaguccuaucuucaggcuccacuucuaacucuaguuuucuugcuguuuuuaucacaucucuaguuacuuccuccacugaaauuuugagccucucagaguuauccaggagggguuggaaucaacuucuuucaaacuccuguuaauguugauagauauuuugacuucucaugaaucaugaacguucuuaaugauaucuagaauagugaauucuuuccagaagguuuucaguuuacucugcccagauccaucagaggaauuacuaucuguggccgcuauaaccuuauaaaauguauuucuuaaguaauaaaacuugaaagucaaaauuaccccuugauacacgggcugcaaaauggauguuguguuagcaggcacgaaaacaacauuaauauccuuguauagcuccaucagagcucccaggugacagguacauugucaaugagcaguaauauuuggaaaggaaucuuuuauugugaccaguaggucucaacagugagcuuaaaauauucaguaaaccaugcuguaaacagauguguugucauucaggcuuuguugcugcauuuauagagcacaggcagaguagauuucacauaauuuuuuauuuuuaaauuuuuuuuacuuuuauuguucuaauuuucaauuuuuauggguauauaguagacgcauauauuuagauuuagccuaauuccuaacagcccuaggauguauggaaucgucaaugagcauuggcuucaauuuaaagucaccaauugcauuagcccuuaacaagagaguuauuaaccuguccuuugaagcuuugaagccaggcauugacuucuccucucuagcugugaaaguccuggauagcaucuucuuccaacagaauagaaugauuuuagcuagaucuucuggauaacuugcugcagcuucucuaucaauaguugcuucuucaccuuacacuuuuauguuauagagacagcuucuuuuccuuaaaccucaugaagcaaccucuguuugcuucaaacuuuuuggguuuuuuuuuguuuuuuaagaagcgccccuugaguuguaucacuucaaacuuuuuuucugcaacuuauucuccucucucagauuucauagaauuggagagaacuagggcuuuucuuuggauuaggcuuuggcuuaagggaauguuguggcuaguuugaucuuuuauccagaccacuaaaacuuucucuauaucagaaauaagacuguuucucuuucuuauauuugauguauucauuggaguaacacuuuuaauuuccuucaagaacuuuuucuuugcauuuauacuuggcuguuaggugcaagacaccuagcuuuuggcuugucuagguuuuugacaugccuucuucacuaggcuuagucauuucuagcuuuugauuuaaagugagagaugugcgauuccuccuuucauauguauacuuagaggccacuguagggucauuaauuggccuaauuucaauauucuuaugucuuuggaaauaugaagucccaaagagagugagggggauggaacggcuggucagaacacacaccacauuuaucgauuagguucacugucuuauaugggcacaguuuguggagccccaaagcaauuacaacaguaacaucaaagaucacugaucauauaucacuauaacagauauaguaauaaugaaaaaguuugaaauauuuugagaauuaccgaaaugcgacauagagacaugaagugagcauauguuguugggaaaauggcacugauagauuuacugcaugcauaguggccacaaaccuucuauuucuaaaaaaacaaacagacaaaaaaaacagcauccaugaagcauaaauaaagcgaagugcaauaaaaugaguuauggcuguauuuuuauaacuaagauauguagaacauugacgaauauaaagcguuaucugcuucacuguggacuuacaaauguaaaauauguauuuguaggaguugcuuucuauuuaugacuguagagagauggagaccaacggcccaggucaccaauuguggaggagauuuccugagcauguucgggaaauacuagaaccucaucuaaauaccagguauguaggcuuauuuaauguauuuucauaaaauuguuuuuaauuauauaaaaauaaugcgauuuuuuuggccgggugcaguggcucacgccuguaaucccagcacuuugggaggcugaggcgggcggaucacgaggucaggaguucgagaucagccugaccaacauggugaaacgccaucucuacuaaaaauacaaaaauuagccgggcgugguggugcacaucuguaaucccagcuacuugggaggcuggggcaggagaaucacuugaacccaggaggcagagguugcagugagccgagauugugccauugcacuacagccugggugacagagcgagacuuuguuuggaaaaaaaaaaaaaaauuaaugugauuuuugauauaguuuuuuaacauuaaaaguguuuuaguaucuccucauguauauuuuucacuaugauuuaugcuuauaauuugucuagaugagaagugcagucugcucauuggguuaaauucuacaacuuuaaauauucagauaaauuuauugaaguuaaaaggauugauuuuuuuaaaaguucaauggucgguaguaaauugaaagaauauacuuuaagcugaaugugaguugaauucuuugauagguauaaguaauacagaaauuuaaaguuuaaagcuagucagaaagccuuuaguaggcccaauuaaagauuuucauuacucccaauuucuccucaugaauauauuuucacccucugcuuuuaaaaaaauguauuuaaucucuuaaaaaauuuaaaugacuuuguuaggacugacgaaauaugcaagaugacaugcaaauacaugaagcauuuuauaugaaaaaaauccauacaacuauaaauuauuucuauuuagaaacuacuuuuugguacccuagguacacaugcauauuagauacuugacuuuggacaaauaacuucuuugaaccuuagaaagugccuagacuuauacuaacagucuuuauaaaagcccagagguaugcauauuuauuuccuagauaauuuuuuauacuuagaaaucuuuuaaacaucauuuuaugucuuaugacuagcauuauuaaagaagugauuauuuagcauuauuauuauuagccuuauuaaagaagaauuauuacuguuauuauuauuauuuuugagacagagucucacucuguugcccaggcuggagugcagugaugcgguaucagcucacugcagccucuaccuccuggguucaagugauucuccugccucagucucccaaguagcugggauuacaggcgugcaccgccaugccuggcuacuuuuuguauuuuuaguagagaugaaguuucaucauauuggccaggcuggucuccuggccuuaagugaucugccugucugggcuucccaaagugcugggauugcaggcaugagccaucacaccuggccacuauuagcauuauuuaaaaaguaaaguuaaagacuaaaguuaaaauuuggauuuucauuuuugaggacuccauacuucccccauuuucuuagucuguauuuuguauagcaccuguagaugucaaagaauuucuguaaucuacuggaaaguuuaugaccuuuguagucacacaggcuuagguuugauuguuggcuuugcauuugcuagcucugaagucuugggcaaguuauuuaacauuuccagguuuuaauuuuuuaauuuugaaaacauggauaauuuuacccacuuuguaugauuauuguuaggaauaaaggagauaauauuaaaaguacuuagcaaagugccugauauuuaguugacacucaauaauaaaugcuuauucaauccuagcuugcuuaauaaguucuuuguuuuuggggggagaauuugugagguuggcuaucauauacuucauaagaaguagaagccaacauuucugccuacuugucauguuuuucauaggaagcaacuuuuaaguggucuuuuaaaaguagaucuuaacaaagcaauggaaauucuuuuggucuuuagcuuuuauaccugagcaguuagaauaaccucucgaaugguuccucaaugauggaaguuaggagauuuaccuaguugggaucugcuuauugaaauuggagccacauaaaauuaagagguugauagagugcguuuucaauagcguugauucccuuuuguaugaaaaacuaaaauaccagguuagccuguagcucaauuuuauagcuuggacugcuugauauuuacuccagaggaccuagggaaauauggaauuucuuaaaagcauauucauauuuuugcugccuuuaaguuauacucccuacuuuauguuuuuuuuuuuuuuaauuugggcucuuuauauauaaucacuaaaucuggauuaaaggauggcuguauuugggagacugaaauuuagaaccagauagaacaacugcaguucaaaaucaccauagaaauaacuuuaggagaaaacaucagguuaugacuaggcagagccuggcuuguaucccaguaucaguaguuuucuagcuaaguuuacuauaaauuugauaaaaaucauccagagaacuauacgcgugaugauucaaaauagggauuugaauuuuuucuccugguuuagugugaugguuaacugagagauuauuggauuuuucaacuguuagaaacuuggaauacagugaaauauguauauauauauauauauauauauuauuuggguauaagacuuuggguauagggcauuuguuauuuccuaagcuuuuauuggugauuugaaagaaacccaugccauucaaaaaaauccuacacacagguagccguaagaugagagcugugugaacauguuuaaauguuaaugcugaggaacaaauagaaagggucauguugaaguaaugugagagagaagugauaguugguguaguaaggaccccaaggagcauccggaaugggagagccguggcccuuauagggaauuauacuuagaaggaauagaucucuuuuuuugcaauagggaaagauaaaauaauggauggaacacagcuaaguuuacagauuucauugcgggaagcaaugauuuuguuuuuacucugugaaguaggagguauaggagaugaccucauuggcugaaaguggcaauggaguugguguaggugacuuuaggaggguggugaugguuugaaauaaucacuggaaaacagaagagagccaauaaugaaaacguagaaggaauucuguaacuuuagcggcccacugacuuugaagacuaagaauacauaguaguacuaaucuuauaaguggguuagugauuuuccuguaucagugcaguagccugaguaucauuucaguaaagacaaauauuuagacugauucaagguugggagguuagcagaugaauaccgcuggaaaagacaguguggcaauggaguggguagaggauauuaccaagagaaugcuagaagugaaggaccauacagacuaagaugguuguggaaagaggcaaagagacaggggugucauagaucaggagagcuuagcagggucacggaacagaagaucucaacaagagagaaugggugugcuggaauaacugggugaaaaaacuggaaauuuaggaaacuaugaccauacaaugagaugucuaaauaauugauuucaaagugaagaaauucuuugaauuagcaugggagcccugauaauuccugagcccugauaaguagagaagaaagucauuggaaacuucugagcuugauuaagugcuccagcuagacacugaagucacccaggaugauaauaacacugggaagaaagaaaacccugagcaguguucuaaaguuaucaaugaguuugguaaucaguguguugcauaguuacccauaaugaggaguagaaaaugguaguauaccuggguggcuugaacuucaaaggaacagguuuuucuuauauaagaagagaguuggaaggaucugaggaagaggagggggcagacucaaauccuuagaaguacuuuagguguccaagaaugaccuacuucaccccuaagaaggauacuggaaaaagguaagcagauugcaguaaaggcaaggcaguacugagguagucaacugaaggaguugcuguaauuuacuaaaauucuaaacagguggauuuaucuuuuuaauaaacaaauuuucaaaauuacagauacaagaguucucagaagucaaccgauuggucuggaguaaagaagccaauuuacuuaaguaaauuggguaguaacuuugcagaauggucagcaucuugggcagguuaucuuauuacaaagguaagaaacccuguucaguuuguuaacugaauggaaauucuaaaggaaaccagaacaucuaucugaaugccuagcacacacaauaaucauugaaguauuugugcugauaaucauagaaauuuuugaagaaaauguuaacuaauagagaauaauaauuucucuguaguuacuaauaauagcuucugagugaaaaguaauuguuuuaccaagaaaauuacuauggucuuaauguguguguaaaauuacauuuauuccuuuuauauuguaaaauaauacuauguaaaaggauguaaaugcuaugucagaguuuuuuacauaauaaaaagacauucaauaaagagauauauuauacucuaauagcauuucuaaaagaaguuauauuaucugaacuuucucuaaaauaaaaauaaagauuuuuacaaugaauuuucauagaaaaacagguauauuucuauuuccuuaaugagaaauuuuuacaugcuggauagacaaaagguacucuguguuccaagaaaauguuuacaguauauuuaaaauuuacaauuuuuguuuuuaauuuaccuuucuuuuuuuuuuuuuuuuuuuuugugacggagucuugcucuugccacccagccggagugcaguggugcgaucucggcucacuguaagucuccgccuaccggguucaagugauucucccgccucagccuccugaguagcugggauuacaggcaugagucaucacacccggcuaaucuuuguauuuuuuuuuuuuuuucgagacagagucucacucugucgcccaggcuggagugcaguggcgcgaucucagcucacugcaagcuccgccucccggguucaugccauucuccugccucagccucccaaguggcugggauuacaggugcccaccaccacgcccggcuaauuuuuuuguauuuuuuuaguagagacgggguuucaccguguuagccaggauggucucgaucuccugaccucaggugaucugcccgccucugccccucaaaguacugguauuacaggcgugagccaccgugccccaccuuuaauuaacauuucuguuaguguuuuaaaauaucauuauacuaauucguaguuaguaacuucaagacauuuucuuuuuuuuugagacggaaucucgcucugucacucaggcuggagugcagucucggcucacugcaaccuccgccucccggguuuaagugguucuccugccucagccucccgaguaucuggaacuacaggcacccgccaccauaccagcuaauuuuuguguguguuuuuuuuguagagacuggguuucaccauguuggccaggauggucucgaucucuugaccucgugauccucccaccuuggccucccaaagugcugggauuacaggcgugagccaccaugcccggcugacauuuucuuuuuuuaaugaauauacugaaaauauaaugugugaaauguggaauacuguuaacuauuuucagcucuggaauauuauggguuuuuuuuuguuuuuuggcuuuguauuugaagaaaaaaucucuuuaaaauuuuaugaguucaacaguguuagcaaaucaaaaguuaagucauaacaaaauuugacuuuaaccccaaauaauuuaauuaaaaaauuaauuaaaaaacuuuuuaaauuuaaaaaugaauacucguuugugauaaauuaucucacaugcuacucuuugacauuuaaucaauaugugaaaguguguuacugucuacacauuuugcauuuacagguucgacaugaucuugccaguaaaauuuucaccugcuguagcauuaugaugaagcaugauuucaaagugaccaucuaucuucuuccacauauucugguguaugucuuacuggguuguaaucaagaagaucagcaggaggugagauaaaucaucuuacuugguuuuugaacaugugaaacuuacuuucuccaauguaauuaguauuagaaaggcuaccuauuaguaggaaauguagaccuauguauggcuauguauguucauuuacauaucuuugccuguuugguguguguaucccuuuaauugauagacguucuauguauauucuagcuaccaauuuguugccagucauauuuucaaaaauuauuccaacuuagucauuuucuuuuuaaccuuuucacauuuugccacgcagaaauuuuaaauguaaaugcaaaauuuauacaucuuuuauagauuauuaauuuuaaaccuuuuaugugaugccucaucuaaugucaugaacuuauuugcuauauuuucuuuuaauccuucuguuuuuauauuuagucuucaauuacucugaacuuaauuuugcauauagugugaaauauuacuguaaguuuuuuucacuguuaacaaaguuucauuaucauuuauugaauaaucuagaauauuuuaaaauuuuuaaaauuuucuuuagucguuaacauauuuucuuuuuagacuaauauuuggauugauuuaauuauagauaagaacaauagaggaauguauuauugaucaauuguguuuuccuuuucuuuuuuugagacagagccucccuuuguugcccagguuggggugcagugaugcucuuggcucacugcaaccuccaccucccagguucaagugauucuccugccucagccuucugaguagcugggauuacacacaugugccaccaugccuggcuaauuuuuuuguauuuuuaguauagacaggguuucaccauguugaccaggcuggucuugaccucaggcaauugggcugccucagccucccaaagugcugggauuacaggccaacaugccuggccaauuguguuuuuucuuuugaaaauuuuugccuuagaaugguuagcuuuagaugucauauaauaguuaaaugguauuauauagauauuauuauuaauuauaaaugauucucauagguuuaugcagaaauuauggcaguucuaaagcaugacgaucagcauaccauaaauacccaagacauugcaucugaucugugucaacucaguacacagacuguguucuccaugcuugaccaucucacacagugggcaaggcacaaauuucaggcacugaaagcugagaaauguccacacagcaaaucaaacagaaauaagguagacucaaugggugaguuaucacuucuguuucuuuuuuuuuuuuuuuuuuagcuauucaccaauuagcucuucccuuuaucaguucuauaauuuaagcacuagcuuaaaaaauaccuugcuucauguuuuuuauuguuguuguuguuguuuggagauggaguuucccucuuguugcccaggcuggagugcaguggcgugaccucggcucacugcaaucucugccucccggguucaagcaauucuccugccucagccucccaaguaguugggauuacaggugcccaccaccacacccagcuaauuuuuucguguauuuuuaguagagacaggguuuugccauauuggccagacuggucucgaacuccugaccucaggugaucuaucugccuuggccucccaaagugcugggauuacaggcaugagccaccgcacccagcuguuuuguguauuuuuaaaauggguaauaguguggccuuuucacugagaaaaaacagugaauuuauaguaauaagaccuuucucucuucuuacucucacuucgacaaggcacauauuuauuuuuucuuuguauaaaaugggguuaauauuuuuauuuuuauuuauuaauuuuuuuuugagauggagucuugcucuguugcccaggcuggagugcagugacaggaucuuggcucacugcaaccucuaccuccuggguucaagcaguucuccugccucagcuuugcgaguagcugggauuacaggugugugccaccauggccagcuaauuuuuguauuuuuaguagagacgggguuucaccauguuggccaggcuggucuccaacuccuggccucaagagauccacccaccucagccucccaaagugcugggauuacaggugugagccaccacaccuggccaaaaugggguuaauauuaucucccuuaggagauuauugugaggaauaaaugagaugaugaacagauaaauuauaaaaugugaaauaaaugagaugcuaauauuguuauuaaccuaauccucccuguuaacauauuauauguuuccucaguuuuuguguguguguguguguguauguguguacucuguucuuugucauucuucacuuggaaaauauucuuuguaaucuuuuucacauuuaaguuuuaaauuucaagggagauuuuaauuuuauuuauuucauggccuaaagagaagcuauuuuuauuuauuuauuuuucuugucucuaguaguguuugauaucuagccagcuguccagauaugcuuaguaugcauuacuacacuacacccugcucuaucuuaccuugcacuguuuuuuuccugugauauuacaacuuucacuaagaagaaucuugauuuaaaaaugacaacugcuaauuugucccuaugauauaagcauugaugagaagaauuauauucaucacacacuaauggauauucuuacuuucuuugaaccuuuuuuuuuuuuccauucuuggcaauaaguggaugguuauaaucuggccuuauaccuuagcuguucucacagacaucaaguauuuuuccuucaggcuuucaggcuaauugaaaaacuaucuaacaguccuuaaagaggccuucacuuccauaauucucaguuugugagcaucucccucuuguucuguugaagcagauacuuuccuguuguuaagcaaaauaguuuauuauuuuucugaaauuuccuggacuugccaauaauuaccugcuuggagaauguuuuugucuggaauguggcuauuaauauauuuuuauauuuaacuauugaauguuuguuuuuuaauuuuuuuuucuuuuuuugagacuaagucucucucuguugcccaggcuggaguugcaguggugugaucuuggcucacugcagcuuccaccuccuggguucaagugauucucaugccucaugcccagcuaauauuuuguacuuuuaguagagacggggcuucaccauguuggccaggcuggucucuaacuccugggcucaagcaguccaucugccucgaucucccaaaguguuggaauuauaggugugagccagcacaaccagccuguuaguuuuuauuucugcaugucaaaaugguacuguaaaaccaaacacucuauuaucaccauuuucagugacaguagcuuuuuuuuuuuuuuuuuuucugagacagucucacucuauagcccaagcuggagugcaguggcaugaucuuggcucacugcaaccuccaccucccaggcuuaagcgauucuugugccucagccuccugaguagcuggggcuacaggcacaugccaccauacccgacuaauuuuuuguauuuuaauggagacaggguuucaccacacugcccaggguggucccaaacuccugcgcucaggcgauccaccugccuuggccucccagagugcugggauuacagacgugagccacugugccuggccaaaauucuagcuuuuaagaauaacauuuguaaugauucaaaaguacaauaccuuuaacauuucuuuaacauuuuuguagagacccccaucucuacaaaaaauacaaaaauuagcugggugugguggugugcaccuguaguccuagguuacucacaaggcugaaguguggggauugcuugagccugugagauugaggcuacggugagacaagaucacaccccugcacuccagccugggcagcagagugagacccugucuccaaaaaaaaaaaaaaaaaaaaaaaaaaaaucagaauuugaaaucaucuacaaauuuugauggaaauaaggaccuuauuuuaaauauaaucuguuuagaauauacuaccuuaggcuaggugugguagcucacaccuguaauccuagcacuuugggaggccgaggcaggaggaucacuugagcucaggaguucaagaucaaccugugcaacauaaugagacuucaucuuuacaaaaaauacaaaacuuggccaggcgugguggcacaugccuauggucccagcuacucgggaggcugaggcaggaucacuuaaguccaggaggugaaggcugcagugagcuaugaucuugccacugcacugcagccucagugagaaugagaucaaaauaauuuuuuuuaaaaaguaaguaaauaaauaaaaauaaaauauacugccuuauuuaaauuuugaagaaauuuguugccuguuuucuacacacuuaugaaucauuaaaauuuagaaguuuuaaauaauucauaaacuagacuguccucauuuagaaguuuuuaauuuuugucuuuuuguacacucuugaaaaauuauccuaaaguacuugugguuuuacuuugaaggcacuuuuacuuucaauuucuuucuuuuuuuuuuuuuuuuugauacggagucucgcucugucacccaggcuggagugcaguggcgugaucucagcucacugcaagcuccgccucccagguucacgccauucuccugccucagccccccgaguagcugggacuaaaggcacccgucaccacgcccggcuaauuuuuuuguauuuuuaguagagacgggguuucaccguguuagccgggauggucucgaucuccuaaccuugugauccgccugccucggccucccaaagugcugggauuacaggcgugaaccaucaugcccagccauuacuuucaauuucuauuguaauaggugauacuguauuuuuggcaaccaagaaaaaauagguggauaacaaugaauucuaaacuuuaaaaaagauuauuuccauaguuuugaaguuucccuacaaaauagcuacauuuaaucauuuuuuauagucaucaaaaauaaugacuaaucuuguaucuuuuguaucaucauuauaucuuuucaaaauuuaauaauagauugauauuuaauccucaccaacaacguuguaaggaaggcaagacagguacuaacauuuuccuuuuauagguaaagaaauagaggcucaguaaauuaaaugacuguccaaagaaagguaaguuauaauggcagaguuggagcaagacucucugaacaauuguucuguuguuaguuacauucuaaauaugauauccuaauauauucagauuaauuuguuuagugaaauaaauugaacuuaaauacuuaaauugacacuuuuaaauuuuaucuuauaagucuuuaauuacucaacuuuuuuuaugaucuaguaucuacuguggauuaugaagacuaucagaguguaacccguuuucuagaccucauaccccaggauacucuggcaguagcuuccuuucgcuccaaagcauacacacgagcuguaaugcacuuugaaucauuuauuacagaaaagaagcaaaauauucaggaacaucuuggauuuuuacaggucugaaguuaauauagugaauuuaauaaugaaaauuaauguggccagucuuuuauguuuauguuguucauuuuauugaauguuuuauaugcuaugcuuagaagcuuauagauuaguggggagagauaaacaucaauuugguauaauauuuuaaguacaguaacacacauguacccugaggaaggacacuuaacucauccauguggaauagggugggagauggaagcggaugagccagaggucaggaauggcuucuuggagauggugucuuaaaaaaugagcaguauagggaggcaagacauuauaaucagaggcaucucuguggaguguuugaaaagagcaugguauaugccaaagaguaaagugucgguuuuggaaugguagaggaaagaucacaaauaauagaagacuuuuuaaguugcccaaacuucuuggagggugcgaacuagggaaguguuauggucacaauggaauuuuagcuaaaugccuguggcaguuguggaggaggaguuuggaagggcuaugauucaaggaauuacucuucuccuugugagaguugugguccugaauuugggagugaguuagugggggcaagugccgguuaugucagguaucaagcaugaaaaugcuggugaaauaaugauuuaggcgauguuaugauuguguagggaagaaaagaaaguaagagcaggugaggcgaauacaguggaauuaaauaagagcucaagauuggugggcuuuucaaaucaaaaagcaaagugugauaaaauaacuagaaaauuaguaacuugcagucuuaagaugaauauuagccccuuccuaucuuuguguuccuccuuguccagcuuuaagucuaugguucaugguuaaaaucguucccuuagagugaugcucaacuucuugucuuuuucccacuguguuguacuccguuugucaaacuccaaccauguaagcagcuggagaaaaauuacacaguggguguuauaacugguuucaguuuaaguucaugaucucaaacaucuuuaaaacugcaggacucuaacauuaccuucaggcuggcuguguuucucuaguaaggcuacuuuccccuuugucaagaugacugucucuuaccuucacuuuguuucccugcuuccagcugacaaucuugcuucaugauucauuaggaaaaaucugcaaaugaaacagcaucugcaccauauucuuuuucuucccuucuguuauuuuauuuauuuauuuauuuugagauagggucuugcucuaucaccuaggcuggaguacaguggcacgagcucggcucacugcaaccuccaccucccaggcucaagggauccucacaccucagccucccgagcagcugggaccacaggcgcugcuaccacaccuggcuaauuuuuuguauuuuuuguagagacgggguuuuccauguugccugggcuggccuccugaccucaagugaucugccugccuuggccucucaaagugcugggauuacaggcaugagccacugugccuggcuucuucuguuauuuuuaaggaaggauuucuuccugucaaaauucaaucuuucuacuuguguucucaauuucaagauguaacuucuucauauauuccuucuuucucuaguguaauuaauuucucuuugggaaccagaguauauggagcauauagacaugcucugguaaauccuaccuucuccuuuagauacaucccaucucucuguuuccggaacuucacaaccaguuuuugaaggaauugucuaguuucuuuauacugcagucacuucuuuguuucucauucacucugcccauuucaacaagacuucucuuuuucuuuucuguugacacuauucuugcuaagaaaauugguggccacauguuaccaaauccaguaaauuuuucccagcccucauuuucuuaaccucaguaucauugaccaugccuuucucauuaagacaucauuugcuuuucucccauggcuucugggauauuuuauucuccaguuuucuuccaaguuaucucacuucuccuguuucauuugccagcucuuccuucuugauaaauguagaaacucuaaucucuaucgucagucugcuuuucuucuuuauccauuuccuagaucaucccauucuuucucauguugugagagacugucuuugugcuaacugauuccuaaauuuuuaucuuuagcuugaauaucuccuuugagcccagauugcugucuugguuuucuugaagucaucucaauaacaauauauuaaaaugguuauuuacauuuuuaaaaauuuaaaaauucaauaaaacucuuauaagcuauacucaacagaauauguuaucauuuggaucuagacaguuuuaggauccugagguucuuuauaaaccuuaugaucaauaacagcuauugauauagauuuguauuuaaaaggaguaagaauguugagggaauagaaugccuggaaauaaguuuauaauuuuacugugacuuugccaugaaacaaaugcuuacuauuacuuugaggaaaaauuucucaaaaaauugcuguuucaauauaaacaggugguuuuauaguuuuauuuccaguuguguuuuuuucuuguuuuugauuguuuuuuaaucauugaacaaagaaauuguaugcugcuaugcaugaaccugauggaguggccggagucagugcaauuagaaaggcagaaccaucucuaaaagaacagauccuugaacaugaaagccuuggcuugcugagggaugccacugcuuguuaugacagggcuauucagcuagaaccagaccagguaagauaauaauugaaaggcaacuguaaugaaaauagcccugaauaggaacucuggaaaccuuaguuuuuuuuguuuuguuuuguuuuguuuuugagacagagucucgcucuguuggccaggcuggagugcaguggcaugaucuuggcucacugcaaccucugucucccgggcucaagcaauucugccucagccucccgaguagcugggauuacaggcgugugccaccacaccacauccagccgaaaccuuaguuuuaauacuguuucugucagugucacugagugucuggaaaauauuuaacccucucuaagcuugaguuuccuaacagauaaaauuagagacuuuacuagaugauuuuaaaaauuccuuccaggccggaugcggcggcucaugccuguaaucccagcacuuugggagaccaagacggguggauuccccgaggucaggaguucgagacuagccuggccaacauagugaaacccugucucuaccaaaaauacaaaaaauuagcugggugugguggcgagcgccuguaaucccagcuacuugggaggcugaggcaagagaauugcuugaacccgggagguggagguugcagugagccaagaucauaccauugcacuccagccugggcaacaugagugaaacucuaucucaaaaaaaaaaaaggucccuuccaauacuauauuuauaugacuuuagaaauccccuaaaugaauaagauuuauuauggaguauaucuguauuaaaauguucauuuaauaacucuaaaauguauauaauuuuaguuugcuauuaaaaguguaagccauggaucaguuuguagaacuagggauucuccauagccugagaaacauuuucauauuuuauacaccuacucacccaccugcacgucucuaaaaugguccuguagaaucacagaguuacaguuaguaaugggaauaagcugugugucuauuggaaugggaaagggguuuagaaucauuaauuuacaaucuugccuuuagauucuuucuaauuuugggauauugcuuuuugucauauuugacauguuucucagaagcacaauauauaaauucuuuauuuuucacaaucuucuuuucauuuuaaaggauaguacauaauccucuuuaacuuuuuagugcuaaagcccgaaauccauauuuaaaacaucaggaccuuugagcuugaauguuuaugugagaaauaugacaaucuuuaaacagaauaucaaagauauuagauacuuuuuauauuggaugugaaccaaaaaguaguccaaauugaaaaauauaauaacuucaaucugagauuuucuauguugucuacauuuauuuauguuacuuuaaauguguuaggacauugauggggguccugccauguaaguaagcaaaucaauuguuaaauuaagaaaggugugacugggcaugguggcucaugccuguaaucccagcacuuugggaggcugaggcaggaggaucacuugagcccaggaguuugagaccagccugggcaacauggcaagacccugucucuacaaaaaauuaaaauaauaauaauaauaaaaaaauaagggcaauaagguaaauaguaauuuuuaaagaauaucaguuaaacuguuuuugguccccaagcuauuauugaagugauaauugcuauuuuaaauauuuuuaaauuucuagaucauucauuaucaugguguaguaaaguccauguuaggucuuggucagcugucuacuguuaucacucaggugaauggagugcaugcuaacagguaauauuuuauaaaaugauuuucuuuuguuauugcaucugaauggagaauuuuuaguuagugaauuggguaauuuaauguuuaguagaguaauaaauguuuuauguguuuucaugguauuggagauaagcaccaacauuuuuuuuuccucaaguuuuucauagucagucuaccacuuaacagcuucugucuaaagagccauccuugaauuagauuugcuuuaacacaaggaacuucuagaacccacuggcuauuggugaggcucagaugggacuuccugggccucaaagggcaucuaugcucugcuuacaguaucaguaccacuuauuuuccgugcuagagguugugacugauuuacggaauaccacuguagacugugugcauugauuuuacccuaaaugauugaugaaugugaaagcagccuuccuuuccuaaagaagguggguuuauuguagaaaaucaaauuaaacaaaaaauaauacauguauguggcaaaacauuaaggcugaguaguucuuccaguuuggagauuaaauguggagauuagcacugcucuugaagcugcuuugcugugagagcugacagcuguauuccuugauuuauucaccagacucuaaauggcuauucugggcaguaaaaucuggucaaaagggaaugggaucucaguuaaacaaagauuauacaggccacuguuuuuggacuacucugaagccaaguuuuucuuucucuuuuuuuucaacuuuuauuuuagauucugaggguacaugugcaaguuagugacaagggcauauuacgugauacugagguuuaggauacaauugaacccaucacccagguagugagcauaguacccaaaagauaguuuuucaacucuugccucccucccucccccaccccuuguagucugcagugucuauuguucccauuuuuguguccauguguacccaauguuuagcucccauuuuauucuuuuuuauagcugcauaguauuccauuguguauaugugccacauuuucuuuaucccaucuaccauugaugggcacuuagguugauuucaugucuuugcuauuaugaauagugcugcaaugaacauacgaguguauguaucuuuuugguagaauggauuauuuuccuuugggaauauacccaguaaugggauugcuguguguucuauuuucaguucuuugggaaaucucuaaaccgccuuccacaguggcugaacuaauuuauauucccaccaacaguguauaaguauucucuuuucucugcagccccuucuacaucuuuuuugacuuuuuaauaauagccauucugggcugggugugguggcucaugccuguaauugcagcacucugggaggccaaggcggguguaucauuugaggccaguaguucaagaccagccuggccaacaugguaaaaccccaucucuacuaaaauaauacaaaaauuagcugggcgugauggugcacaucuguaaucccagcuacucgggagacugaggcaggagaauugcuugaaccugggagauggagguugcagugagcugagauugcaccacugcacuccagccugggcagcagagggagacuuugucucaaaauaauaauaauaauaguagccauucugauuagugugaggugguaucucauuguggcuuugauuuucauuucucaaauaauugugacgacgagcauguuuucauaugcuuguuggcugcuuguaugucuucuuuugagaagugucugcucauguccuuugccuacuuuuuaaugggguuguuuguuuuuuugcuuguugauuuauuugagcuuuuuauagauucugaagccagccuuuucuaaguacuguuuguauagguuccaaaacugugauucauaaagacuaucauuuuacaaugucuaagggcagagaaguucacuguuggucagaugguaucacaguaguggaauuuaugaaaucacaagggaaguuuuacagaaguaaagaaggaaugcuuauauguuguggauauguuucuccagauuaguugagagacuuuaugaauaaauagauuacagggauuugggagagucauggcucaaauuggggugucaaauuucuuuuugacauagacuacacauucagacuccucuuuucuucucuuugggucugggauacauagagccuccugauuuggguugugaaaaaggcaugcgucaauauucaaugaaggggugcugugucauggugaagcaaaugauuauggauggggcauguuuuucuugggguaauuucuguuugcauuaaacaaauauuuuuccuaaaauauugacugugccugcccuauuuaucauucuuuuuaauguacccauuuauguggauacauucucacagccugauccugauugccauuuguacuuuuugcuauaagucuucgugugacacauccccuuuguuaucugauaucccauagauaaucuguuaucccacaguuggauaacaaauacugccuaauucuacugagauuuuuauccugaaauuuuuauauuuuggugucugaugguaagcuuguaaaguccuucaaaauuggacuuuugaaaauuacauuucaguuguauuucuuuagccuuauucuaaacuguuuuuggugguggucauaaauuuagaaauuggaauccucuagcuucuauuuuuagaauuuuuaaaaaugaaacuuguuagaucacuuguugucuuuucuuuauguguuuuuacuacaauaaaaagagcaaggaaaacuuuugaggauauugauuccagccucucuguuacuuuauuuauaauauggauauauaugugcuguaugcaguguuauuagauuauuaaauggaaaauuguaccuagccuaggaucuaaacauauggcagaaauucagaaaguaugauuaauaaaaaagaaacaugaggaaagccuagcgguuucuguguagucaugaucucaaauaucacuggucauccuaaugucaccuaaguagaaugcuuagaacaaaauaauuagccuauaucauacugguuuugcaaacucaaauuuuaaacuaacugaaaguaguuuaaaaauagguauauauuuuacguagcuaguuuuauauacuuuguuaugccauugacaaaucauuguaacuuucuuuugcucuugguauuguucuagauaccucccaacuguccguaaguuauaccacuggccccccuguauuuuugucuuaaauuuaauucagaauucugaguuauuggaauugcuuaccucugaauuuauguguguucaguuggcucuuuuucuuccuugcucuuuguucaaauuaagcaugcagcuauuuuuacaaugggcuuaguuauuauucaggaauuaacucugcucuaauauauggcacacuuuaauuuguugaagaaugucauuuuaaaugguguaucagaaguaauuagugaaaaaauauuuuugaaggauggaaagauuaaaauuuucuggauaguuucuggauagagauaauuauuuuauaucuaagaacaaaauacaauauaaugcaaauucaauaaauauaauaaauagaguauguaaaccaaugaaaaaucucugaaugucaccuuaaauaaauuaaaguuuaguugauauggguuucuuuuaauagguccgaguggacagaugaauuaaacacguacagaguggaagcagcuuggaaauugucacagugggauuugguggaaaacuauuuggcagcagguaaaauuacuucuuaaaauauaagcaguuuuaggaugggugcgguggcucacgccuguaaucccagcacuuugggcggcugaggcgggcggaucaugaggucaggagaucgagaccauccuggcuaacacagugaaaccccgucucuacuaaaaauacaaaaaauuagcugggcgugguggcacgcgccuguagucccaacuacucgggaggcugaggcaggagaauugcuugaaccugggaguuggagguugcagugagcugagaucgcgccacugcacuccagccugggugacagagugagacuccaucucaaagaaaaaaaaaaaaagcgguuuuaauaugacauaaauauucagacuuaaguaacuuagcaacauucauacuuaauaucuuagccuguuuuaugauugccuuguuuaguuguucaaaguagaaugaaaccaggcugggcaugguggcucacaccuguaaucucaguguuuugggaggccaaggugggaggauugcuugaagccaagagcucuagaccagucugggcaaaauacugagacugucucugcaaaaauguuuuuuaaaaaacuuagcugggcaugguggcucaugccuguucaccuacucaggagacugaggugggaggaucacuggagcccagaaguucaaggcugcagugagcuauaaucaugccauagcccucuauccuggaccacagagugagacucugucucaaaaaaaaaaaaaggaaugaagccaccuguuugauauuucagcugaccauuuuaucuaaugaaauaaagcugacucuuggacccagcuaccgugacauuucuugacucuucauuuguuuuucagauggaaaaucuacaacauggagugucagacugggacagcuauuauuaucagccaaaaaaagagauaucacagcuuuuuaugacucacugaaacuagugagagcagaacaaauuguaccucuuucagcugcaagcuuugaaagaggcuccuaccaacgaggauaugaauauauugugagguauuuuggaauuuccauuuuuauauuucuggccuauaaaugucaccugacaggauuggaaaauuuuuuugaguaaauaauugauagugaguuugguuucaugcauagcuacacuagacagcucuuucauucuuuuuaccucacaaucacccuacaguuaaaauucuaacauacauccuuuuaaggaaaggcaacuaugagacuaaugaaaaacauaauaaaaauaucuuauguuuguccucuuguaaugucauaguuugcuuucuauauaaccaaauauaauauagacaucuauagcaccuggcacauuggugcuugguauuuguuguuucccuuuccuuuucauuuagaaauguguuugauauuuccccccaaaaauauaggcaucacauuacuagaaagaauauuaacuuuuauaggugaagaagaaaauguuggaaaacauuuuaggucuaugaauucuaccugaggaaaaaugauaaacuaaauauuguaauuaagguauaagaaauuuacuacauagcacuguuuuuuuaaguuagaagaauucauuauauuuaguaucaacccguuuggugauaucuuaaugaaacuagagauuggaccacugaguuuaauucuguucuguagcuacucagcuauauccuuguaccuugaacacugaaucauagacacugacuaucauacaagggggaaaaagcuagugugaauguaucaaaguuuccaucacucuuagaaaaaaacuacauuaauuucauaauuuuuuacuaucaucugcuaugccaggcccucuuauaguagcaccagcaauauaugcaaauaccucauguugguuuauaauggauccauauuuucuuuuaucuucauuuaggugguaaauuuugguuucauacauuugaauuuaguuuuauccaucauucuccaguuuaauuaggaauuugggauucacugcaaaucccuaaauauuuauuuuaaaaguuuaauguaauuaauuuuauuuauuuauuuauuuauuuauuuauuauuuuaagggacggggucuugcuaugucaccugagcuggagugcaguggcuauucacaggcauaaucauagcucacugcaaccuugaacuccugaguucaagugauccaccugccucagucuccugaguagcuggaguacaggugcacgcuaccaugccuggcuaaagcaccaaauguauaaaccagcauaaauugguguuuacauucaguuugaaaagauauaaauguaauuauuuacuuagcaaggauauauuaaaguucuaccaaagacaacuguguauuuuaaauucuuuauuucugauuuaaaguacuugcuuuauauaugagauuaauaaggcugaauaugauaacauuuuaacauaggcucuaucuaucuucagauugcacauguuaugugaguuggagcauagcaucaaaccacuuuuccagcauucuccaggugacaguucucaagaagauucucuaaacuggguagcucgacuagaaaugacccagaauuccuacagagccaaggagccuauccuggcucuccggagggcuuuacuaagccucaacaaaagguuucucacacuacuuuuuuuaaaaaugucacuuaucuugaauuugguauuuggauauuauuuggggguguuuguauuucuuaauuuucugucugaaucuacauuuuucuauuuuuaaugaucagggcuacacuaucugguugaaaggaaccuagaacuuaagaaucacuuuuagacaccauuucuuucucuuuuuuaagauguuaaaaacauaucugggggauauguuuuuuacugauaaaaaucaagaauaagguucauaauagguaaaacagaacacuguaagaaaaguuaagucaaggcuuuuuaaacaaauuaauaauuaauuccuuugaaauaguauaugaagaagguucuguauugggaacagaggcuuucaaaacauuggaacuacuugcaaaguuuaugaccuagauuuaaauuguuuuaaguuaaguuguuguguacacuuaccaauggucucucucaccaauguguuguuacuuccuuuagaccagauuacaaugaaaugguuggagaaugcuggcugcagagugccaggguagcuagaaaggcuggucaccaccagacagccuacaaugcucuccuuaaugcaggggaaucacgacucgcugaacuguacguggaaagggcaaaguggcucugguccaagguaauggccagggaaaugucaucauauauauauauauauauauauauauauauauauauauauauauauauauauauauauagucgggaauuauguacuuccuuaaaaggccaacugagagaacauaacuaauccaaauuaagaaccuuccuuuucuaucacuuuucuucauuaguuaucuaccauagccuggaaguaauuguucuuuuuacucuacaguccccagauaccuucccauuucaaggcugaauguggaguuuuuucaguuuucaucuaucuuacauuuuccuugaggaaaacgaccucuuaauuuuucaccuuauguauguauacaggguguauauaguagugacccaguaaauguugguuaaaugaauguaacucugucacuuaguugcuggcagauaauuagcucucuguagacuugccaguguuacuguaaauauucagcucugaucuagccagaaagggccuagcaucugaacagaaguucacggcagaccucagauuaaagccaaaguaauaagaaggggguuuuuuaaacauuggaacuacuugcaagguuuaugacccagauuuauuuuuuauuuuuauuuauuuauuuauuuauuuauuuugaaccggagucucacucuguugcccaggcuggagugcaguggcacgaucuccgcucacuacaaccucugccucccgaguucaagugauucuccugccucagccuccugaguagcugggacuacgggugugugccaccacaccuggcuaauuuuuuguauuuuuaguagagaugggguuucaccguguuagccaggguggucucgaucuccugaccucaugauccaccugccucagccacccaaagugcugggauuacaggcgugagccaccgcgccuggccaauaacccagauuuaauggcuauuacuuaaauuucuccucaggcuagucaccaguuuagaauuaguaauaggcauuacuaauaauaauagcauguucuggaauugauacuuagcaacuauuguuggugccauuugugguuacaccaacuugugguggcugagaaaggacaggagagguuuccuggaugagaggggaaagcaauuuauucagugugcauuagucaguaccuggucauuuuauugagcuagugguagucuauguauuauaauaccuuaaacucaaaauguucaaaaugcaauuuauuaccuaauacucaauaucuguuucuccucucauguuuccuacuucucugaacaagacuuuauuccauccuuccaucaaaaacagaaaucuggacaucaucuuaaauuccuucugcaaccucacuuuucacauccagcuggagacuaaaucuuuguucuucaaccuuagaaauaucucuugaauccucucccucuuauuuauuuccacugcuuuaacuuaugacuuuauuauuuacuuccucuaacaauauuaacaaccauuuuaggaucucaccauuucccuguauacguuauugcaguuugugaucuuucuaaaauccacaucgaaucauguugcuccuucaaaaagauuaaaucuuacaaaguauucuucauaccuuuaggauuaagccuaacucuaggaacuacacaaaucccuuucugaucaaguccuggccuacuuccucagugucauucaucaccaucucaaaaacccuuuaaacuucagcuaaaaucagacuaugugcuuuucuuccaauuaaaauuauuauuccaucuaccuagaaugccuuucacuaaauucucugccaagaagauuucuacucauucuugaaaaccuaauucaaauuuucuucguugauaacuuuuccugacuguaguucuccuccauuuuccuauauucuucagguagguuuaagggacucucuucucuauccuguauaaugcugauguauauuccucuguuguaacacuuagcaaauaugcuuuuauuucacauaguuucuuuucucaugugacuaugaacuuuuuuuaugucagggauuuuaauuuguuugugauugucuucaauucccugaacuuugauuauaguccuuucuugauauccauggagggauuggucccaggauucucuauggauaacaaaaucuguggauacucaaguccuuuauauaaaguggcauacacaguauuugcauauaaccugcggacauccucuuguauacuucucuaggcuacuuauaauaccuaauacagugcaaaugcuuuguaaacaguuguuauacuuguauugcuuauucauauuauuuuuaauuuuuucuuuguaauauuucuuuuuuuuuuuaauuuaaauuuuuauguuuugagagagacagagucuugcucuguugcccaggcuggagugcaguggcaugaucauagcucacugaugccuuggacuccugcucucaagcaauccucccaccucacccugaacuuuguaucaaaggcuauaagcauaagccaucaugccuagcuuucuuuuuuuuuuuuuaagagagaggaucuugcucugucacccaggcuggagagcaguggugugucauagcucacuguaacugcgaauuccugggcucaagcgauccuucccccucagccucccgaguagcuggaauuauaggcaugagccacuacaccuggguaauuuuuaaauuuuuuguagagacaggaucuugcuauguugcccaggcuaguaucaaacuccuggccccaagcagucccccugccuuggcauccaaaagcacuggaauugcagagaugagccacugugcccagccauuccuaauauuuucuauccacuguugguugaauccauugauguggaaccuguggcuacagagagccaacugcaguuauaaaauuaauuaguaaaugaaugaaugagaugaagcaauguuucaguuuuagaauuuuacuuuaauaagaggcaaguaaaagauaaacaugaaauuacaaauggauuuguacaaaaacauaaugaacuaauacuuuugcagaaaauagaaguauguuuuuaaauuaaaaggcuuauuguugccuuuuuucuuuuagggugauguucaccaggcacuaauuguucuucaaaaagguguugaauuauguuuuccugaaaaugaaaccccaccugaggguaagaacauguuaauccauggucgagcuaugcuacuagugggccgauuuauggaagaaacagcuaacuuugaaagcaaugcaauuaugaaaaaauauaaggcaaguauauguauaaugcaguuucaguuaacucuguugacuacguaaaaugacuuaagucuauauggcaaagcacauguauaaaaauaaccaggaaauuuuuuugacuuuucagugaguauauaaguauauggauuaucacaaaauaaauauacucaugaaacugccaccacaucaagaaauagaauauuauuugagcucuauaaccccacuacccuucaucccaguaaucacuauucucacccucugucucaaaguuaacuacauccuagccugaaaauuuuucagcaaaaccaauuuauaacuucuuuacuagguauuaaacuuuauauagaugguguuguaagagauauaccucucaauaauccaugggucaaugaaaacuuucaauggaaauugaaaaguacuuugaacugaaugauaauaaaaauggcauaucauauccugugcagcuaaagccauucuuaaaagggauuuaaauuuuuauuugcauauauucgaagaaaauaaagguucaaaauuaacgaguuaaguaucuaucccaaagaguuagaaaaggaacuaaaaaaguagggagagaaauaaaaaaguagaagaaaggaaauaauaaagcaaagagcagguggcuagaauuugugggacagauuaacugagagaaaaaaguuaaacagaguaguuccuaucugcauaggaauuguguucgcugaauaccagccugcacaugaauaauucagaauucuaugaggccaagcuaggaauaacugcuggggaaagaauaaacaugcagaggcuauaagaacaauuuccagagcucacacgggauugagauucauucagauuacaggauugagaguuauucaguccaccagccagauuaagaggccucauugcauaauauggagcauucaguaaagaccuuaaaagggccacaccuuagaaguaggacuaaauuaguccuaggcuaaaaacuacucuauauccauacuagaagggcaguaaaacaagcuuuaagaugauuacacugaucuucaaguaaccuuacugccugccagaucaaagccuaacacucuuuaaagcaagacaacaaaaucuaaaacuugacaauguaaaaauauauccagcauccauuaaaaaauuacucugugaaugaagaagcaggaauauuugagccacagauaggaaaaaaaauaaaucaguagaaauaguucuagaaaugacaggauuuaaaaacagcuauuguauauaggcuccauaaguuuaagaacauaaacaaaaauaagagcaugaugagaagagagagaaaucaaagauacaagaaagaccuaaaugggaccaacagccaaagcaaauggcacagacagugcuaaucuuuagauccaggaaguguugcauucugaugaagauaaauaggaguccagcuccuguuccuugguuacaagaagaugucaugccaccuaagaaacuaaccuugauuugcauuaaaaacuauauuauccuaaagggcagugauaaugaggcaaguucugaaaccauacuuguaaguuucaccuucccaguuagagagaucuucugaauuuauucuaguauguaagacacaacaacuuaugaggcacacaaaaacucaccaguacuuaacagcagaauuugauagcaaauauuccaguucucccaucucugccuggguacuaaagccaggguuagggaagagagauguugucagacuaccaacuuuucagguucuguuucuucugcauacaccccuaauuuccugucauaaaggccucaguagcugcuucucuuguucugguugccuauacaugauguagacagaaaugaguagagaaaagaauagaggcugacuacuguagaaugacaugcagauccaaggggccacauauugcaugauuccacuuacaugaaauggccagaauaagcaaauccauagagacagaagguagauuaauggguacuagagacugagguuggggcugggaagugacugcuaauugguacaauuuuuuuuuuggagugaugaaaauguucuggaauuaaauaguggugaugguuacacaacucuguaaauauacuaacaacaacuuuaaaagugugaacuuuauaauauauuaauuauaucccaauagagcugucauuuuaaaauauuacccaaauggcaaucuuuaaauaaaaaaagaaguaaaagauacaaggacuaggaaaaaaauauaggaaaguuauuaauugcagaugauaugaauacauauguagaaaauucaaaagauuauaaacuauucaaaauauugagugaauuaaacaagauugccugaugauuuuauuucuauaugacaacaagaaaggaauuuaaaacauaccauuuacaagcagaaaguacuugaacaguuggauaucuguaugaggaaaaaaaugaucuucaaccucugccucauaugauagacaaaauugcuucaaaaaaguagauuauagaucuaaacugaaaagcuaaaauuaugaauuuuuagaugaaaaaauagaagaaaaucuuuacaaccuuaggguaggcaaagguuuucuuaggucacacaaagcauuaagcauuuaaaaaauccugauaaauuagauguucaucaaaguuaaaaccuuuucuaagaaagacaguuaagaaaaugaaaagguaagccauagacuuggagaaaauacuuguaauacauauaugacagaggauuuguagcuaaauuauagagaacccuacaacuuaguaagacaauuuaaagaucugugaggcuaggcacaguggcucaggccuguaaucccggugcuuugggaggccgaggccugaggaucacuugaagcuaggaguucaaaaccagccugggcaauauagugagaaccugucucugcaaaaauaaaaauuagccagguauggugacgaaugccuauaguuuuagcuauucgggaggcuaaagcaggaggaucacuugagccuaggaguucaagguuacaguuagcuaugauugcaccacugcauuccagccugaguuacagagugaaacuuugucuauuaaaagaaaaaaaauacagaucugcaaaagucuuggauagacacuucauaaagaauacacgcaaauggccaaaaagcaaaugaaaagaugcuuaacaucauuagucauuaggaagaugcaaauuaaaaccacaaugaaauaacacauuacacacuaaaauggcuaaagucugaaagacuagcaauaccuauuaaugcaauaaaugcaccugguggggacuauaaaaaguuaaaucuaccauauuccauuccauucuuagguguuuauccaacagaaacaauuacauaugucaauaaaaagacuuguacacaaauguuuauaguagguuuagucacaaaaacuggaaauaggccagcuggccauccagagaagaauggguaaacaaacugguacaguuguauaauggaauacuacccuacaguaagaagaaaugaacuacugauacacgcaacaagguagauuaaugucauagauaugcugaaugaaagaagagggacauaaaagacuauaugcuuauaugauuucauuuaugugacauuuuagaacagguauaauuaauguauaugcauagaaauuauaucaguauuugccuggguaguuggcaggagagugacggcaagggugggcgcccauaagaacuuucgagaguuaggaauguucaucuucuugacuggaaugaugguuccauggguguauaugucuuaagaaaguugauuuaaaauuuuacuuuauuuuauuuuugagacagggucuuggucugucaacccaggcuggaguauaguggcaugauuacagcucacugcagccucaaccuccugggcucaagugauccucccaccucagccucucaaguagcugggacuacaggcacaugccaccacacccagcuaauuuuuuauuuuguggagauagggucuugcuguucugccaaggcuggucucaaacucccuggccucuacugauccucccaccucugccucccaaagugcugggauuauaguugugagccaccauguaugcccagccuaaaauuuuuaaagauaucauuuaggauagcaauaaaaaugaugaaaugccuaggauuaaauugcacacaagaccucuccacaaaauaaaaauuaaaacauuaaaauugagugaaguaaaaaagaacuaaauaaauugguagcuagaauacauguaugaaugggaagacucaauaauauaauuauuucucuacaaacugaccuagagguuuaaugcauuacucaucaaaugcuaacagguaauugacaauuagaauuuaaaacuuauguggaaacauaaaggccaagaauaaccaagaagcuucucugucaccuuucauuuuuucaguuuuaauuugaaauaaucuuugacuucuaaaaaguuaguaguaguauagggaauuuccauaucuacccuuuaccguguuuccacuaauuuuaauaucuuacacuaccagaguaucagaagugggaaauuaauauugauaaacaauacuguuaacuaucuguagaccacauuucaccaguuuucccaauaguguucuucuucugucuagaauuaaggauuccauauagcauuaguugucauaucuccuuagugaccuccaaucuaucugagaugcucuuuacuguaucgugugaggucaggugcagggagaaaauaguuggcccaaucaaaagagguaauuggggagaguuuaaugaaaaacuagauuaagggaaauuaacaaaggauggugaaaguaccccauggcuagcaacaacagagagucguugcuaacucuagaccugaaggagcaaaaggauagggcauuuacuggaaccuguacagggagcuaaauuuguaggaaaggaccauuggaccagaacuuaaccuuagggaaagaaacaccaccacugucaacugcagcccagcaggaaggaaacgagcagguauaaagaccuuaaccucacucucccccucacccucuaaucuauugcuaccuuccauugauugaacuucacaggaagccagagggcaaacaggcccauugauauaaaucaucaauuucaguuugcuggggcacugagcagaguggaaaaggcuaaaguuggcaaguguaucuaucuggaggggcaaacugugaauaaccaaaauagucuuuucaauaaauguuguuguaucacuuggguaucuuauaggaaaacaaaaaaucaaacuugaucccuucuucccaccauaaacaaaaguaaacuugagguagauuguuaaucuaggucaggacuucuuaaacauaacaaaaacacuaacccuaaaauaaacaauaacuucuguuuaucagaagauaccauugugaguuagaggcaaccuacagauuagaagauauuugcaauacauuagaggcucauaucuggaauaugacccagcauguccccagaggauaaacacaagaauguuuauaacauuauuauuuguagauuuuauauuggaaguaauccaaauggcaaucaguuauagaauggauaaauauguuguagcauauucuuauaauggaauacuauauaguaaaccaaauuuauaugcaauaacuuggauugauaucacaaauguaauguugaaugaaauaagccagauaaaaaauauaauacacguagggcugggcaugguggcucaugccuauaaucccagcacuuugggaggcugaggcaggcggauugcuugagcugaggaguucaaggccagccuaggaaacauagcaaaucuccgucucuacaaaaaauacaaaaauuagcuggguguggugguacaugccucuagucccagcugcuccguaggcugaggagggaggauugccuugagccuaggaguuguggcugcagggagucaugagcaugccacugcacaccagccaggacaacagggcaaaaccuugucucuaauaauaauauguauuuuuuuggagauggugucucgcucugucgcucaggcuggagugcaguugcgcgaucuuggcucauugcaagcuccgccucccagguucaggccagucuccugccuccgccucccgaguagcugggacuacaggcgccugccaccgcccggcuaauuguuuuuuuuuuuuuuuuuuuuuuguauuuuuaguagagaccagguuucaccguguuagccaggauggucucaaucuccugaccucgugauccgcccaccugggccucccaaagugcugggauuacaagcauaagccaucuugcccagccaauaauaauaauuauuauaguaugauucuauuuauauaaaaguucaaaaacagacaaaaaacuccuggaguucuuguaugaggaugauaaauuuguaauaauugaucaaguuguauacauaagauucauauauguuucuguauauaaacuuuauuuuucaaaauaaaacuuaaaaaucuuaacuaaaaagggagcgagagagaagagagggaggaaggagauuuuauauaaagguaauuacuuugugauaauugaucaagcuguaaauguaauauuaguguauuuuucaguaugugaauuuuacuuuucaaaauaaauauuuaaaaucuaagcugaaaugagagagggaggaggaaggaaguuagggaaggaggaagaaaggaaggcaggaagacaggcaggaaagaagaaaggaaggaaagacuagauugacuaauauguuuuucuggcagcccuuacccuguguggcugauuagguacaugaaccuagcaugugccacacgucuaaucauaucauucuguccucuauucccaggcagguuugugucuguagagucucaagauuagagucaguagaaacucaagaucucacuuaagguuucuggucuaaacuguucucaaacuucuuuagaugaaaaguggaacuucaauuaaaaaaaaaauugucagugauccuguguauuucccaucacauuucauguaauauuaaaaauuaauaaaccacacaaauauuuaaggcaggaacagcaaaaagaaaugacaaaggagacuaagugagaguggccagaaagagaggagaaaacuuggaagaugguggccucacagaagucaagggaugaaagcauuugaaauaagugacuuggacaacagaaacauauugaagagaguucaaaugagaucagaguuguaaaauaucucuuggauuuaaggagcuccuuaguggaguggugaagacugaagcugaaaagacauaguuuuaggaaucaaugugagguagagaauccuuuuuagaagccugcuucugaaggaauugagagaaagggcaauaacuugugagagaucuuggagaaaaacaaaauaugugauuuuuauuuuaccaaaauuuuuaugcuuuuuaaaguccuacacucuuuagagacuugauauuacuucugcuuugaagauuuuuaaaaaugccuuucaugauauauguguauauacacacacacacauaucauauauauguauaaaaaaauuuaacccauccagacacuacuuugauguaucuuuuaaaguggugacauaaauggaguuuucuccuaaguugcgaauucuuccagcacuauuucauguugggcagugggcaacccaccagaacaaaucagcccuccugagaaaaccuuuacaagaaguuagcuauuccuuuuccacaucaaagauugagucugcuuuugacuuugcucugccuagauaaaggucacauacuuuugaucccuaaucaucuauucauauuuuacuucccagcauagcgugggauuuccuuagguagguauccuauguucuuuuuuauaggaugugaccgcgugccugccagaaugggaggaugggcauuuuuaccuugccaaguacuaugacaaauugaugcccauggucacagacaacaaaauggaaaagcaaggugaucucauccgguauauaguucuucauuuuggcaggugaguaugagaacugcauguuugcagauuaaauauguaaggaugacuauuaauauugaaacuguuaucacaugucuuagcauauucuagguauuuucuggcuuaugacugauucaguguaucaccuuagauaagauguaaauuuuuccuuuaugcaacuuuuuucuucacuuuaaaaacuuuuuaaaugaaaaaagugauauagacauguguuuuggaaacucucucuaacuauguuauuccucugcucucacaccaacacagcaaucaucaacacaguagaagacuuacaugaccaaagauguggguuuuuuuccccauacaccaagcaguggacaccagcuugguguccuccaauucuguucugacacucucuaccuggagacggugucauaccucagagguugagggcuuggugacacaagaccaucuccuccuucccuuaguugcaagucugggccucuggaacuucugaccaacuggcuucaaguugggguucucacaaccuccucuuggguucaauaaauuugcuagaguggcucacagaacucagggaaacauuuuuacuaguuuauuaagaaagauauuuuaaaggaugcaaauaaacagucugaugaagagauagguagggugaggucuggagggguccggcacaggagcuucugucuccauggagaugggcugugccauccuccuggcacguggaugaggucuucuucacccuccugucagccuccacguguucaccucucuggaagcucuccaaacucuguccugugggguuuuuaauggagucuuuauuacaugggcaugauugacaaccauguagaaaugugaguggacaaauagcucauaauguaaacccagcaaggucugucuguucagacuuuucuuggccuuuucuauguagcauuccuuccucuaggauauggggcaggauccucucugggaugaggaucuuuugacucacagucagauuagaauccucccuuaggcagaugagugaaggacaggagaagcucauagagagagauucuguuuccugaggccuaaagugcccugacauuaaaacgaggaguuaggagccaguaacugugaacuaaaaccaauauauguauuauaauuccacagccuggauuuuuaaaaaaauucaacagcaccaaauuaaguauccuucucauuccagacccucauccccugaguccccaaccauagaauuccagaagacccuuaaugucauauuucgugguuauauauauauauauuuuauuuuauuuuauuucauuuuauuuuauuuuauuuauuuuaagacagagucuugcucugucgcccaggcuggagugcaauggcacgaucucagcucacugcaaccucugcuuccagguucaagcgacucuggcucacccuucugaguagcugguauuacaggcgugugccaccacacccaguuaauuuuuguauuuuuaguauagacgggguuucaccauguuggucaggcuggucucgaacuccugaccucgugauccacccaccacggccucccaaagugcugggauuauagaugugagccacuccacucagccuuugugguuauauuuuauugcaauggaguacuuccuucuagcccauuccaauaagaagugguauaauauauauacaugaaaaugauuuugacauuagacuuguagaaaguacuuauucuuaaacuaguuaauaggugaaauauaacuuuuaauuucauauaucgguguauuauagucaaguauaaucucaggccuacuguuuauguuuuuauaaauuauuaauugcuaagaaacaauaucauuccauacauucuccuuaucauacucauguaccauugcuuuacauggaaggauaucuucagaucaauauaucuguuaaaauugccuauuaugagguacuaugacuucucaguuaaauauuuucagaaauuaaagcaauaucuguaagccacgggugguggugugugccuguaguccuagcuacuuuggagguugaggugggaggauuaccugaaccugggacgucaaggcaguggugagcugugauugcaccacugcacagcagccuggauaacagagcaagacccugucucaaaaaaaaaaaaagaaagaaagaaaaaaaaaaaagaaagaaagggggcauauguucucaggaucuccugagggcugugucacacgagaaaaaaaauggaaaaaaaaagcaauauuuguucaucaucaaugguauuaggguagcaaaaugaguaaagguacuaaaggcaguucuucuuuuuuuuuuuuuuuaauugacaaaguaucacucugucacugaggcaggagugcaguacaaucauagcuaacuaugaccuugaacucugggcucaagugauccuccugccucagccuccuuaguaguuaggacuauaggcacaugccaccaugcccaacuauguuuuuaaauaauuuuuuguagagacagggucucacuauguugcucaggcugaucuugagcuccuggccucaagcaaucuucccaccucagccucccaacgcucugagauuacaggugugagccaucacucuuggcccaguucuuuugaaaaaugaguaauagcuucuuuuguuugcucuuuagucuuaguauauaucaugugccuugggauauagaauuuacuuaacacauuucuuuuaaaacaaguggcuauauaaaguccucuauaugcauaaaacuguuauguauagugaguauuuuuaaaguacccuucaggaauguaaguacauuuuaaaaccuguuucuauccauaguaguuaaaauaaaauauuuguaugcuuaagggaguaaacuuagcuauugagacauauuuauccccugacugaauaauuguguuauuacugauuaaauaucaauguuugcccuuaagaaucuaggauccaauuaggguuagaaaccuuaaguacauaaaacauuuaaauaaugguacauaauagaaugugugauuagauaucaaaauaggcugggcucaguggcucaugucuguaaccucagaauuuugggaggcugaggcaggcagauugcuugagcccaugaguucaaaaccagccagagcaacaugguaagaacccaucucuaccaaaaaaaauacaaaaauuauccaggcaugguggugcacaccuguggucccagcuacaagggaagcuaagccaagaggauugcuugagcccaggagguggagauugcggagagcuaugaucaugccacugcacuccugccugggugacagagaaagacucuaucucaaaaaaaaaauaaauaaauaaaucaaaauaaauguaguaaauaucagauauggcugggcacggugauuaaugccuguaaucccagaauuuugggaugcugaaauggaaggauugcuugagcccaggaguucaagaaaagccuagggaacauggcaagaccucaucucuacaaaaaauaaauaaaucagccaggcauaggguguacaaccauggucccagcuaugugggaggcuauauuagccagauaccaaaagugaaccaaacaaguccagaagucauggaggucaaaagucaagccacaagccacuggcuuuaugauuucaaaaguguacuucuuugcauugaauugcuacaaaagucugguaaaccucaugaagaagguauacuaguaauccaaauucaacagcacauuaaaaggaucauucaccaugaccaaguggaauuuacuccagaaugcaaggaugguucaacauauccaaauacauauauuugauauaccacauuaauagaaugaaggacaaaaaccauaugaucaucucaucucaauagaugcagagaaagcacuugacaaaauucaacauccuuuuaugacuaaaaaguuucagaggggcgguuccaagauggccgaauaggaacagcuccagucuacagcucccagcaugagcagcgcagaagaugggugauuucugcauuuccaacugagguaccggguucaucucacuggggcuugucagacagugggugcaggacagugggugcagcgcaccgagcaugagccgaagcagggcaaggcauugccucaccugggaagugcaaggggucagggaauuccuuuucauagccaagcaaagcugugacagauggcaccuggaaaaucaggucacucccacccuaauacugcgcuuuuccaauggucuuagcaaacagcacaccaggagauuauaucccgugcauggcucugaaggucccaugcccacggagccucucucauugcuagcauagcagucugagaucgaacugcaaggcggcagcaaggcugggggaggagugcccgccauugcugaggcuugaguagguaaacaaaguggcuggaaagcuggaacuggguggagcccacugcagcucaaggaggccugccugccucuguagacuccaccucugggggcagggcauagcugaacaaaaggcagcagaaaccucugcagacuuaaaugucccugucugacagcuuugaagagaguagugcuucucccagcacggaguuugagaucugagcacugacagacugccuccucaagugggacccugacaccugaguagccuaacugggaggcaucccccaguaggggcagacugacaccucacacggccggguaccccuuugagacgaaaccuccagaggaacaaucagacagcaacauuugcuguucagcaauauuugcuguucugcagccuccgcugcugauacccaggcaaacagagucuggaguggaucuccagcaaacuccaacagaccuguagcugaggguccugacuguuaaaaggaaaacuaacaaacagaaagggcauccacaccaaaaccgcaucuguacgucacuaucaucaaagaccaaagguagauaaaaccacaaagauggggaaaaaacagaacagaaaaacugaaaauucuaaaaaucagagggccucuccuccuccaaaggaacgcagcuccucaccagcaacggaacaaagcuggacagagaaugacuuugacgaguugagagaagaaggcuucagaugaucaaacuucuccgagcuaaaggaggaaguuggaacccauggcaaagaaguuaaaaaccuugaaaaaagauuagacgaauggcugacuagaauaaccaaugcagagaaauccuuaaaggaccugauggagcugaaauccacggcacaggaacuacgugacgaaugcacaagcuucaguagccgauucgaucaacuggaagaaaggguaucagugauugaagaucaaaugaaugaaaugaagcgagaagagaaguuuagagaaaaaagaauaaaaagaaacgaacaaagccuccaagaaauaugggacuaugugaaaagaccaaaucuaugucugauugguguaccugaaagugauggggaaauggaaacaaguuggaaaacacucugcaggauauaauccaggagaacuuccccaaccuagcaaggcaggccaacauucaaauucaggaaauacagagaacgccacaaagauacuccucgagaagagcaacuccaagacacauaauugucagauucaccaaaguugaaaugaaggaacgaacguuaagggcagccagagagaaaggucggguuacccacaaagggaaccccaucagacuaacagcugaucucucggcagaaauucuacaagccagaagagagugggggccaauauucaaaauucuuaaggaaaagaauuuucaacccagaauuucauauccagccaaacuaagcuucaaaagugaaggagaaauaaaauccuuuacagacaagcaaaugcugagagauuuugucaccaccaggccuguccuaaaagagcuccugaaggaagcacuaaacauggaaaggaacaaucgguaccagccacugcagaaacaugccaaauuguaaagaccaucgaugcuaggaagaaacugcaucaacuaacgagcaaaauaaccagcuaacaucauacugagaggaucaaauucacacauaacaauauuaaccuuaaauguaaaugggcuaaaugcuccaguuaaaagacacagacuggcaaauuggauagagucaagacccaucagugugcuguauucaggagacccaucucacgugcagagacacacauaggcucaaaauaaaaggauggaggaagaucuaccaagcaaauggaaaacaaaaaaaggcagggguugaaauccuagucucugauaaaacagacuuuaaaccaacaaagaucaaaagagacaaagaaggccauuacauaaugguaaagggaucaauucaacaagaagagcuaacuauccuaaauauauaugcacccaauacaggagcacccagauucauaaagcaaguccaagagacccacaaagagacuuagacucgcacacaauaauaaugggagacuuuaacaccccacugucaacauuagacagaucaacgagacagaagguuaacaagaauauccaggaauugaauucagcucugccccaagcagaccuaauagacaucuacagaacucuccaccccaaaucaacagaauauacauucuucucagcaccacaccacaccuauuccaaaacugaccacauaguuggaaguaaagcacuccucagcaaauguaaaagaacagaaauuauaacaaacugucucucagaccacagugcaaucaaacuagaacccaggauuaagaaacucaaucaaaacugcucaacugcaugggaacugaacaaccugcuccugaaugacuacuggguacauaacgaaaugaaggcagaaauaaagauauucuuugaaaccaacgagaacaaagacgcaacauaccagaaucucugggacacauuuaaagcaguguguagagggaaauuuauagcacuaaaugcccacaagagaaagcaggaaagauuuaaaauugacacccuaacaucacaauuaaaagaacuagaaaagcaagagcaaacacauucaaaagcuggcagaaggcaagaaauaacuuaggucagagcagagcugaaggagauggagacacaaaaaacccuucacaaaaucaaugaauccaggagcugguuuuuggaaaagaucaacaaaauugauagacugcuagcuagacuaauaaagaagaaaagagagaagaaucaaauagaugcaauaaaaaauguuaaaggggauaucaccgaucccacagaaauacaaacuaccaucagagaauacuauaaacaccucuaugcaaauaagcuagaaaaucuagaagaaauggauaaauuccuggacacauacacccucccaagacuaaaccaggaagaaguugaaucucuuaauggaccaauaacaggcucugaaauugaggcaauaauuaauagcuuaccaaccaaaaaaaguccaggaccagauggauucacagccgaauucuaccagagguacaaggaggaacugguaccauucauucugaaacuauuucaaucaauagagaaagagggaguccucccuaacucauuuuaugaggccagcaucauccugauaccaaagccuggcagagacacaacaaaaaaagagaauuuuaaaccaauaucccugaugaacauugaugcaaaaauccucaauaaaauacuggcaaaccgaauccagcagcacaucaaaaagcuuauccaccaugaugaagugggcuucaucccugggauguaaggcugguucaacauacacaaaucaacaaauguaauccauccuauaaacagaagcaaagacaaaaaccacaugauuaugucaauagaugcagaaaaggccuuugacaaaauucaacagcccuucaugcuaaaaacucucaauaaauuagguauugaugggacauaucuaaaaauaauaagagcuauuuaugacagacucacagccaauauacugaaugggcaaaaacuggaagcauuccuuuugaaaacuggcauaagacagggaugcccucucucaccacuccuauucaacauaguguuggaaguucuggccagggcaaucaggcaggagaaagaaauaaagggcauucaacuaggaaaagaggaagucaaauugucccuguuugcagacgacaugauuguauaucuagaaaaccccaucaucucagccccaaauuucuuuaagcugauaagcaacuucaccaaagucucaggauacaaaaucaaugugcaaaaaucacaagcauacuuauacaccaauaacagacaaacagagacccaaaucaugagugaacuccuauucacaauugcuucaaagagaauaaaauacccaggaauccaacuuacaagggaugugaaggaccucuucaaggagaacuacaaaccauugcucaaggaaauaaaagaggacacaaacaaauggaagaacauuccaugcucauggauaggaagaaucaauaucgugaaaauggccauacugcccaagguaauuuauagauucaaugccauccccaucaagcuaccaaugacuuucuucacagaauuggaaaaaacuacuuuaaaguucauaugaaaccaaaaaagagccugcauugccaagucaauccuaagccaaaagaacaaagcuggaggcaucacgcuaccugacuucaagcuauacuacaaggcuacaguaaccaaaacagcaugguacugguaccaaaacagagauauagaccaauggaacagaacagagcccucagaaauaaugccacacaucuacaacuaucugaucuucgaccacccugacaaaaacaagaaauggggaaaggauucccuauuuaacaaaugaugcugggaaaacuggcuagcuguauguagaaagcugaaacuggauccuuccuuacaccuuauacgaaaauuaauucaagauggauuaaagacuuaaaugucagaccuaaaaccguaaaaacccuagaagaaaaccuaggcaauaccauuugggacauaggcaugggcaaggacuucaugucuaaaacaccaaaagcaauggcaacaaaagccaaaauugacaaauggggucuaauuaaacuaaagagcuucugcacagcaaaagaaacuaccaucagagugaacaggcaacuuacagaaugggagaaaauuuuugcaaucuacucaucugacgaagggcuaauauccagaaucuacaaagaacucaaacaaauuuacaagaaaaaaacaaccccaucaaaaagugggcgaaggauauaacagacacuucucaaaagaagacauuuaugcagccaacagacacaugaaaaaaaugcucaucaucacuggccaucagagaaaugcaaaucaaaaccacaaugagauaccaucucacaccaguuagaauggcgaucauuaaaaagucaggaaacaacaggugcuggagaggauguggagaaauaggaacacguuuacacuguuguugggacuguaaacuaguucaaccauuguggaagucauuguggcgguuccucggggaucuagaacuagaaauaccauuugaccuagccaucccauuacuggguauauacccaaaggaauauaaaucaugcugcuauaaagacacaugcacauguauguuuauugcggcacuauucacaauagcaaagacuuggaaccaacccaaauguccaacaaugauagacuggauuaagaaaauguggcacauauaccccauggaauacuaugcagccauaaaaaaggaugaguucauguccuuuguagggacauggaugaagcuggaaaccaucauucucagcaaacuaucgaaggacaaaaaaccaaacaccgcauguucucauucauagcugggaauugaacaaugagaacacuuggacacaggaaggggaacaucacacacuggggccuguuguggggugaggggcugggggagggauagcauuaggagauauaccuaauguuaaaugacgaguuaaugggugcagcacaccaacauggcacauguauacauaucuaaaaaccugcacguugugcacauguacucuauaacuuaaaguauaauuaaaaacauauauauauaaaacauaacauguauauaaguuguaaagcauaauaauagaaugaacauccauuaaucuagucuaaccuuuaugucaccccucuaucccuggaggcaaccacuauucccaauuuuguguuuuucauuccuuuguuuuuuaaaauaaaagaggcuuuuuaaaaaaaaacaaacuuuuuuuaaaaaaaaaauauguauagaaggaauguaccucaacacaguaaagaccauguaugauaaccccaaagauaacaucauacucaguggugaaaaguucaaagcuuuuccucuaagauuaagacaaagaugcccacucuugccacuuauauucaauauaguaccaggaauccuagccauagcaauucgagaagagagauaaauaaaaggcauccaaauuggaaaagaagucaucaauuuuuuucuauuugcagacgacaugauuuuauauacugaaacccuaagacuccaauaaaagacuauuagaacaaauaaaugaauucaauaaaguugcaggauauaaaggcaacauacaaaaguaaguagcauuucuauacacuaauaacagaguacuugcagauaaauuaagaagacaaucucauuuacaguagcuacaaaaauaaaauauaauacuugggaauaaauacaaggcaaaagaccuauacaaugaaaacuauaaaacauugaugaaaagaaauugaagaagacaugaacaaauggaaagauauccuguuuauguauuggaagaauuaauauuauuaaaauguucauagugcccaaagugaucuacagauucaauguaguuucuaucagaauuccaauagcuuauucuuucuuuccuuuuuuuuuuguuuuguuuuguuuaaaaauucuggcugggcacaguggcucacacccauaaucccagcacuuugggaaacugaggcagguggaucacuugaggucaggaguuugagaccagccuggccaacauagugaaaccuagucucuacugaaaauacaaaaauuagccaggcaugguggcacacaucuguaaucccagcuacuagggaggcugaggcaggaaaauugcuugaacccaggaggcggagguuacagugaaccaagaucgugccucugcacuccagacugggagucucaaaaaaaaaaaaaaaaaaauccaauaacuuuuuucacagaaguagaaaaaaaaauccuaaaauuuguauggaccuagaaaagaccucagauaaccaaagaaaucuugagcaagaacaaagcuggccgggcgugguggcucacaccuguaaucauagcgaggcugagguggguggauugccugagcucaggaguucaagaucagccagggcaacacggugaaaccccaucucuacuaaaauacagaaaauuagcugggcaugguggcaugcaccuguaauccuagcuacucaggagguugaggcaggagaguugcuggaacccgggagguggagguuacagugagccgagauugugccauugcacuccagccugggugacagacugagacuaugucucuaaaaaaaaaaaaaaagaauaaagcugaaggcaucacacuaccugacuucaaaauuauaccacaaagcuauaauaaucaaaacaguaugacauuaguauuaaaauggcuacauagaccaguggaacagagacccuagaaaugaauccacgcauuuacagucaauugaucuuugacaaaggugccaagaacccacaaugcagaaaggacagucucuucaauaaaugguguugggacaacuggauguccacaugcaauagaauggaauuacacucuuaccuuacaccauauacaaaaaucaacucaaaauggcuuaaaaacuuaaauguaagaccugaagcuguaaaacuacuagaagaaaacauagaggaaaagguucauggcauugguuugggcaauaauuuuuuuggauaugaaccaaaaagcacagccaacaaaagcaaauauagacaaaugauauuauacaaaccaaaagacuucugcauagccaaggaaacaaucaacagagugaaaagacaaccuauagaaugggagaauguauuugcaaaccacacaucugauaggggguuaauagccaaaauagguaaggaacucaaacaacuuaauaguaagaaagcaaaucaccuggccaggcaugguggcucaugcauguaaucccagcacuuugagaggcucaggcagauggaucguuugagcccaggaguucaagaccagccugggcaacauggugaaacccccaucucuacaaaaaaauacaaaaauuauucgggcguggugguaugcaccugcagucccagcugcucaggaggcugaggcaggggcaucacuuuagccuaggagguggagguugcagugagccaggaucauaucacugcacuccagcccaggcaacagagccagauccugucugaaaaaauaaaaauaaaaauagaaaaaaggaaacaaauuacccaauuaaaaaaaaugggaaaagggucugagcagacauauuucaaaagaagacauaaaaaugaccaacagagguauauaaaaaaaguucggcaucguuaaucaucagauaaaugcaaauuaaaaccacaaugagaugucaccucacacuuguuugaauggcuaucauauaaaagacaaaagauaacaagcauuggagaggauauggggaaaagggaacccuuauacacuguuggugggaagguaaauuaguagagccauuauggaaaacaguauggagauuccuuaaaaauuaaaaauagaaauaucauaugaucuagcaaucccauuaugggguauauaucuaaaggaaauuaaaucaauauguugaagagauaucugcacucccauguucauugcagcaucuucacaacagccaagcuauggaaucaaacuaaguguccaucaacaugggaaugaauaaagaaaauguggcauauguauguauacuuauacacacacacacacacacacacacacacacacacacacaauggaauacuauucaggcuuaaaaaagaaggaauccuguuauuugugcgaagauggaugaaccuggagauuauucuaagugaaguaagccuggcacagaaagauuaauacugaauuaucuuacuuauauguagaaucuaaaaauguugaacucauagaacuagagaguagaauggugauuaccagggguuggaguagugaggaguuggggagauguuggucaaaggacauaaaacuucaguuaaauagaaggaauaaguuaaagagaucuacucuacaacauggucacuauaguuaacaaauguuuuguauugaaaauugcugagaauagauuuuauuccacaacaaaauaaauaugugaaauaauuagcaugcgugaguuagcuugguuuagcucuuccacaauguauacauguuucaaaacaugugcacaauaaauauacacaauuuuuauuuguugauuuaaauaaauaaaugaaauguuuaaaaacaaaaacauuauguugugcaccuuuaaaaaaaccugcuagcucuccuaauuucugguuaaauuaaucuugacaaaauaagaaggggaaaagaaaguccccacuucuucuauaguuguagaaugguaaaugcaauucuaugucauuaaacugucucuaugggucucaaaaagauaucuguacauucguguucauagcaacauuauucauaauagcuaaaacaugaaagcagugcaagaguucauugggagauuaauugaucagcaaaaugugauguagacacaauggaauauuauucugcuuuaaaaaggaaggaaauucugacauaugguacaacauagaugaaccucgaggacauuaugcuaagugaaauaagccagucacaaaaaggacaaauacuguauguuuccacuuauaugagguaccuucaauggucaaauucaugaagacagaaaguacaauggugguugccagagacuggguggggaaggagacgggaaguuacuguuuaauagguacgagguuccaauuugggaagaugaaaaaaguucuggagggggaaugguggugaugauuacgcaacaaugugaauguacaaccauauuaauauaacacugaacuguacacuuaaaaaugguugugauggcaaauuuuauguuauguauguuuuaccacaauaaaauuucuuuugaaaauaaacugauguccaggccccuaaaaaauucaagaaggagagaacuuuaacuuuucacaaauuuuaccagaaacagcguugagugguugguuuguaggauggugcagaaacuagaccugauggaagauguauacuggugaguggcaagaugcuaagauuggaaaauuauggagauaaaagauucugaauguuugaaucccaggcagaaucauuuauauaguuuuaauauguagguauugauuccuguuuuuuaauaaggggagagcaugauaaagccagaauuucaggaauguuagucuggaauuuacugaaggguagaaauauggauuuagggugaccaaguuauuauaauuucccagaaauagaaugauuggaccuaaccuaggcuuauggccaaagaaugcaaaugaaggcacagagauccuaaggaaaaauugaaagaaguauugauagacuuugauuagagcagaauuuguauaauguacaaauucuguauacuguaaguggaaacauacaguauguacauguuuuugguacagggaauguagaacuaagugagcuaaaaaggagacagaggagucaaaaauaacuucuaggaagaaauauugauaccauaauuuuugugaaaacgguaugugguaguuugaaucuuuaaauuuuaauucguauaauauaaaaaugacagcuaugcuaauaguguuucuugucuauauaauugcagaucucuacaauauggaaaucaguucauauaucagucaaugccacgaauguuaacucuauggcuugauuaugguacaaaggcauaugaaugggaaaaagguauaacucuucacguaaaaguuuuaaaggacuaggaauuauaacuuugguauaaagucagauuuggcuggacagucuaauuuccuagaagcuuggaaugaauuugauaauuaagauauuauguaagugugaguaagauacuaaauguuaaaaaggaaagacaaaucauagacuuuuaaaguaguuuuaauucagggccacaaauacaaaucugauuauuucuuaaugaaucuaacacauauuaaaauguguuaguuuuagccaaauaauuuacccuaaaaauuaaaauggauagugaaaauuaaugucccuuggguuuuugaauggcucuaaauauuuuuucugguuggacagagacaacuaucuuuucacaaauuggcaagugaccuaaccuugggcaugggaauaacauacuuuaaagcuauuuuuaaagcaaaauuuuucuucugugaaaugaacugauauacugauuuuucucuuuccuuuauuguuuuuuaaacuuauuucuucccccagcuggccgcuccgaucguguacaaaugaggaaugauuuggguaaaauaaacaagguuaucacagagcauacaaacuauuuagcuccauaucaauuuuugacugcuuuuucacaauugaucucucgaauuugucauucucacgaugaaguuuuuguugucuugauggaaauaauagccaaaguauuucuagccuauccucaacaagcaauguggaugaugacagcugugucaaagguaaaagggucuuuuaccuuuuuauaugaaaagaucuuuuaccauuuuauaugaacuugauuauguaauacuaauauguagauacaaguuccagggcgucucuccuguauuagauuaguaauuuuaaauauuuuuuuaaagagagaaauuuauagcauuauaucuuaauauuuggauauauuuaccauaugaaaugaaguaacuaguauguuuaagaucaaauaauucagcauguguuuucuuuaugaagucuaguaaacaguuaaugcuugaugcaaaaugguuaccuauguuuucacaaauauuuuaauccaaacuaccugaauuuuuauuuuuuuucccuuaagaaacaggaucuuucucuguugcccaggcuggaaugcaguggugggaucauagcucagugcagccucaaaguccuggguucaagugauccucuugccucagcuucccaguagcuaggaugauagcggugugucaccauguacaguuaauuuuuaaauucuuuuuguagagaugggaucuugcuguguugcucaggcugggcucaaacucuugggcucaagugaucuuucugcuuuggccucccaaagugcuggaauuacaggcaugagcuaucgugccccgccaguaccugaauuauuaauacuaaaaaaccguuauugcaucauuaaugggaauucauauguuggucaauauauguaauaaguaaauguuuagagaauuuagacaauacagagacauaaaacaaaaauuaaaauucacaccuugggccauucauuaauguuuugauguaauuuuauuuguauauuuucuagcauauuuuaacacuaaauuuaauuauguugccguacaauuucauauuuuucacuuuauuguuuccauguuauuaaauauaauuugaagauauaauuuuaauauauaaaauucuaaaaaauagccuucaauaacuuauuuaacuguuuaguuaaucauuaagguuauuucuauuuuucuugcaauuguaacacaucuagauaugucuauguuuauucucacuuguaauuauuucuccagggcagaucccuauaacuuuauaauucacaaaguuauaggguggcaauauuuguauggcucuugauagcauugccaaauaaauuuucagaaaauuuguaucauauaaacucucaucaugaauacuuuuuaaguuuuuugucaagcaaaaaauuuaucuuuuaaaaauccuguauaaacucuuuuuuaugacauuuaacucuuuuuuaugacagucaucuuaucccaugcgugugaacagaugcaaggaaauccucaauaaagcuauucauaugaaaaaauccuuagagaaguuuguuggagaugcaacucgccuaacagauaagcuucuagaauugugcaauaaaccgguacuaucauaaucuuagugcuuauaaacugauguuggguaauuauguauauaauuugagcagauuuuuucauuugauuaauuaaauuaaaauucuaacuauagguguacacauauaucaaaauguauauuuuaauuauguaugauuugucuuaauaaagcaguuuuuaauauuucuaauacaucuuacuuccaaauacccucuaauauuucuaaaaguucuucuuagugugaauuaagaauuuuccgagaguagauauccauguuucucagcaauuuuuaguagagaauaugaaauaagccauaaaaauauaaguauguaaaauauucuaaguuacuuaugguagucuaugauuauaucauaucuuuaaacuuucaaaauucauauacauuauuaaacuacacuuacgauagggaagaggguugggguuuugcuuuucauucuuuuaguacacauuucagugccuaugaggggacaagcacuaugcuaagggaaacaagaugaauaaaaucuauucucaugccugaggugcuuacagucuuuuagggaacuaagcagaugguuaucuagaguaauaaguacuuuuuucgguagauuugugacuaaaguaggaacaugguuacaggaguaaccccauaauucuaccuaaguauuagagaaaaacccccaaggauguauaggaaagauaaaagugggaggugggggugguuauaaggagggagagagaaguucuuuaauaagguacauagcuagacuucacuugacaaauauucagagugcaucaguguuuauagaugaaaagauacagacuauuucucaccuuuccuuuaucaauaaacaucucaaaaggguaaucugcauuuauuaucuccauuaaucccauuugaccucugaugcacuugacauuaucaaaaacaguguuaugguggccaacauuuauuaaaacacuaacacuguuguaagugcuuuacauguacagguuuccaguucuuuaucugaaaccuuuguggcaagcuacacuuagaaauuuaggauuuuuaagauuuuagugcauauuuaauauuugauauuuccacugaggguaaccuguuggaguaucccauaaucaaacacauaacuguuucuucagugagaguuuaauuuacagagcucuuuggauuuucuaauauuugauaauagauuauaggccucuacucucuccuuuaaucauuaaacaauccuaugauguagguacuauuauuaaugagguaaaugacagagguuaaaaugggaugauuaggaaauacuuagaaaaccacagacugcugaaccuuuguaaucaaaauauuguaaaagugaaauuuuuguuauaguggaauuuaagguaaaaacaaauuaaaaugcacuauuuauuuuuucagguugauggaaguaguuccacauuaagcaugagcacucauuuuaaaaugcuuaaaaagcugguagaagaagcaacauuuagugaaauccucauuccucuacaaucagucaugauaccuacacuuccaucaauucuggguacccaugcuaaccaugcuagccaugaaccauuuccuggacauugggccuauauugcaggguuugaugauaugguaaacuucaguuuuauaugacuaugauuuuaaaauuuaguuguuaaaaacuucaaauuaagauaaaaaguguauuucacaaaaucuacgugaaucuuauuugugaagaaaaauaauuggaaauacagaagaguaaaacuaaacucauuuguacugauggcaaaaaaauucagugauuaaaaaaaguucugauucaugauucacauucaccguaacguuuugauuuuucaaaugcuccuguuguuuuaguaugacuauaaucuuuauuuuuucacaauuugauuuuucuuuucuuuucuuuuuuuuuuuuuuuggaaacagggucucauucuguugcccggguuggguggaauacaguggugcgaucucagcucacugcaaccucugccucuuaggcucaagcaauuugcucaccucagccuccugaguagcugggacuacaggugcaugucaccaugcccagcuaauuuuuuaaauuuuuuguagauacgggguuucgucauguugcccaggcuagucuugaacuccuaggcucaagccauucuccugcucagccuucccaaguguuaguguaacaaacaugagccacuguacccagucuaugcuuuguuuuuaauuuaagcaguauuauucaucuuauuuacucacuucauuagguacacuuaauuuugaaggaguuuguuuuuucaaaaaucaaacuacuuuuaauugauaaagcuugaaaaacagagucucaggcuccgcagaaagauccugaaaagauguuucaaaaaucuuuuaaacauuuugacugcuuugaaggggggugucuaaauuugaauauguaaguacuuguauuggcgaugaaguaaucuuuuuaugucauagcuauuuuuaaugggugaaaauguuucuguucauagacagucauucuuuucauaggucauagauaauuaaaauaaaagauuuuuaaaauacaaauucacuacauaauauagcugguaauauucuuuuuuuuuuuuuacauaacucaagguuuauaauauauagacauuuacacagaaauuuuuggcccuaauucauauauaacucaucaucuuuuagguggaaauucuugcuucucuucagaaaccaaagaagauuucuuuaaaaggcucagauggaaaguucuacaucaugauguguaagccaaaagaugaccugagaaaggauuguagacuaauggaauucaauuccuugauuaauaagguugggagauaguuugcuuuuauuuuauuuauuuauuuuuuauuuuaaaaaaauuuuugacuauuauaaaaccagauugcuuuuauuucagaguugcuauaauuacuaucaaucugauauaggcauuuuaguauacaaacagaucacucuuaaaaagcaggaaugaaauauaaagucuuuuucauuuucacuuaauuuuuuuauugagauaaaauguacauacauaaaacuuaacauuugacaguuuuugaaguauauuguucaguggcauuaaguacauucacauuguuguacaaccaucaccaccaucccucuccaaaacuuuuuucaucuucccaaauuggaacucugugucuaugaaacaauuaacuuccuauuucccuucuccucagccuccagcagccaccauuuacuuugucuccauuaauuuaaccauuugagguaccucauauaagugcaguauuucuccuuuuaugacuggcuuaaaucacuuggcauuauucaaaguucauucauuuuacagcauguguuagaauuuucucccucuuuaagcugaauaauagucuauuguuuuccauccacauuuuauuuaucuauuuauccagugauggacauuuggaugcuucuaccuuuuggcuauuguguuaauauauuuaucaaaagauaaauaggcugggugcaguggcucauaccuguaagccuaacacuuugggaggcccaggaaagaggaccacuugaggccaagaguuugagaccagccuggccuauauagugaaacccugucucuacaaaaaauaaaaaaaauuagccaggcaugguggcacaugccuguagucccagcuacuaaggaggcugaggcaggaggauuguuugagcccaggaguuugaggcuacagugagcuaugaucaugccacugcacucuagcccagaugacagagccaagacccugacucuuauaaauaaauaaauagauaaauaaaagguaaucauuagcauuuuuucaguucuguugguauuugauuucuaucucaaagaugauaugaggaaucuuauuaaaggguuauuauaaauguaugguuuuauguauuuugaauuauucuguaaccagguauuuguagaugcauaguguaugucuuuuuccauugguaaaaauugaucuauacuguggaaagaugaaacuuuauuauuuuucuacaagcuuuuuuucccuucuucucauugccuucccacauuuuaaagucauagaucuuuagcauagaaaagauauagcaguagaugaguuuguuuuuuaaaaaaaguuauagucugcuugguuuaaccaaaaguaauuuaaaaauuaauaccacauuaaaaagcuauuucaaaagcaauaugaaaaggaggauuauuuuuuauuuuaacauauuauuugggcugggugugguggcucaugccuguaaucccagcugaggcgggcagaucacuugaggccaguaguucgagaccagccuggccaacauggcaaaaaccuuucucuacuaaaaauacaaaaauuagccaggcauggugguguacgccaguauucccagcuacuugggaggcugaggcaugagaauugguugagccugggaggcggagguugcagugagcccagaucgugccacugcacuccagccugggugacagagugagauucugucucaacaacaacaacaaaaaaguauuguuuguuaaaaugguaccuuaauucacuaacuacugaaccauuaguauguucucuccaaagcucccugaguuuuucugaguaucagauuuacuugaguaucaaguggccuggcuuuaguuuauaaauuuacauuaaucagcuuuguuacuuuaauuaaaguauuuuguuacauuuucccucauaaacaugguaaaauaaaauagccugacauacuaacuuaguuaguaacauauuuacuaacauaguuuuguaaaaaacuauguuaguuuuggaggccacacacugaucuuuauaugagauucuauggccauauuguuuuccugguaguuauggaaccuauuuccuaaaguaaaauguauuuuugaucagugauugugcuuuugaauugagcagguuacaauuacagaugugugcuuacuucauacaggucuagaauuaaacauaauacuguuuauuuccaccugauauaucaggaucaaucagaugaaauauguaaggcuuucuucugcuaagggauagcuuuagaaauaagguugugauaaaccgcaagaggagcaauacauuuugaggaugucauagaacucaugcucuuuuguuuauguauuuuagaaauaauuaaaauuggccgggcacaguggcucaugccuguaaucccagcacuuugggaggccgaggcaggcggaucacuaggucaggagaucgagaccauccuggcuaacacggugaaacccugucucuacuaaaaauacaaaaaauuagcugggcgugguggcaggcaccuauagucccaccuacucgggaggcugaggcaggagaauggcaagaacccgagaggcagaguuugcagugagccgagauugagccacugcacuccagcuugggcgacagagcaagacuccaucucaaaaaaaaaaaagaaaaauuaaauagcagucucugugccuaaagacuuaauguuucaguaauaccuauaaagcaauagaaaauaaaacagcagcauuuugucauuguuaaauauacaacuuaaauauuuuaaauacaauauucuugucacauuaauagugaauaauuaaaaagaaggaccuacccaggacauuuuuaauaaucuguaaauagauuagagauacugucccaguagcuuccuuccuaccauucagaagaauuauucauguauaccacauaguaagccuucaaugacauucuuugguuaugaaaugaacaaucuuuaaauauauuugauauaacauuuagaaauuuugaguucuaucuuguuuuuaaauuuauguguauuuuuuaacagugcuuaagaaaagaugcagagucucguagaagagaacuucauauucgaacauaugcaguuauuccacuaaaugaugaaugugggauuauugaaugggugaacaacacugcugguuugagaccuauucugaccaaacuauauaaagaaaaggguacuaaaauuaauucuuauacauauacaguguggguacuaaguuauauaauauggguauaauugguauuaauauaugcuagcauauguuuuuugauauaagcuauagugaaauuucuagauuuuauauacagaaacacuuaaguguuuccaucccuuccuuccuuucuuccuuccuuccuuccuuccauuuugauuccuucccugucuucaucccaacaggauuugagguagcuuacaaaacuauauaugaauauuuguuuuucacagauauugguuaacaauucugaaacuauguauauacaguacuagucuucagcaaguaaguaaauauguuguauaaugagagccaguuuucucacuauuggagaaaggaaggagagaaggcuagaaugaagucugacguuuuagauuggaauaagaggcuccaacuguccaaaccugggauaauuugaguagcaaaauaaauaaugauuguaaacuauuauaacccauggaauaaacaaauaaacaugaguccauacugauauaaacagauauuugaguaaauaaauaaauagggaagugggaauaguucuuccuuauguacuaauagaauuucaaugaauaaauguagaaaggaugauggaaaugggaaaucagcaauuagcaaacacuauaguaauuauuauugcaggcagugauuauuaauggaugcuaaaauuaauaggcaaaagaugagaaacagguuauuugaagaaucuugaaguaucucccuaucagauacuuaacaauuauaaagggaaaaguauaguaacuuuacaguagagaaauauaaauauaacugguccgaacuccuuacaaaugucaaaguaaugaauucccagauuugaugacauuaaggaguugacauuugaugacaacuaaauguaauguguaauccuggauuggauccugaccccuaaacaaagugugcuagugggacagcuggugaaauuugaauaaggucagagguuugguuaauaauacuguaauaauaagaauuuccugauuugaauaauuguacuauuguuacgcaagauaugaacauuaaggaaagcugggugaagaauaugugggaacuccguaucauugaugcaacuuuuuguaacaucuaaacuuguuuuaaaauaagacguuuuuaaaguucauaugguguaauacauuaaaaaugaauagaucaaguugucaaagugaaguagaaaauaaguauauguuuucauacauaauuuguaugguauuugccauaacaaauuacugcaaacuaagcgaguuuaaacaauagaaauuuaucaucucacgguucuggaggcuaaagauacaauaucaaguugucauuaggaccaugaucucucugaaggcuaauguuccuugccuuucucuuaaccuucugguguucuguggcuucuggauguauuguaccacauugccuuuauuguuacauagcauucucucuaugucucugugucucuauuuucucauaagaacaccagucacuggauuauugaauuaagggcccaccuuaaugacuuuaucuuaacaacauuacaucugcaaagauccuguuacugaauaagcucacauucccagguaccaagaauuaggauuucagcauauuuuuuugagagauaaaguucaauuuauaacauuaaguaauacugauaaaucacuauauaauggguauugugccaaguauguuauguacauuauuuuauuuauuauuguuaacacgccugauuauccaucccuauuuuauggacagugccagagaacuuacguaacuugucuaaguucacaguugcaaaacugaaacucagagacacuugagucagaguucaaagaacuugcuguugacuauuuuauuuaugagcaugacauauuguauaugucugaguuuggauuugaaaauauauuuuuucuugauaauuugugucaguguaaaaaauauauguauauauacauauauauugauauguacacauauaugcaaaauaaguucauucauaugggacuuaauuuugagucuuguauucuggaacuauuugauuucacaacacugguuuuaacugacauuaauuuucaucaauaagaggcuucacuuggguaaguacgguggucccuccuuaucuggaggauugcuuccagaauacccucacauaccaaaauccacacauacucaagucucagucagcccugcagaaccugcauguaugaaaagucagccuucaguauauacugauuuuacaucccauguuuuugauccauguuugguugaaaaaaaucacauguaaguggacccacacaguucaaacucauguuguucaagggucaucuguauuaagggaagauaaugugguuuauuauuuuauuauacaaucaguaacuuuauguaugcuuaauugaaaaauguuccuuuauucuuguuuuucaauaacaauuugaauaaaaguagauguuucuuguccaauuuuaacaaaaaaaacuuugccccuuuuuucauuuggcugaugugauuaauggauaucacucuuccuugcaggaguguauaugacaggaaaagaacuucgccaguguaugcuaccaaagucagcagcuuuaucugaaaaacucaaaguauuccgagaauuucuccugcccaggcauccuccuauuuuucaugagugguuucugagaacauucccugauccuacaucaugguaaguuaccaagaauauaauacguuguuaugguugaauguuuauuuuuaauauuuuagauuuauauuggccucauauguauauggauauuucauaggcauuguguuucuuuuagguacaguaguagaucagcuuacugccguuccacugcaguaaugucaaugguugguuauauucuggggcuuggagaccgucauggugaaaauauucucuuugauucuuugacuggugaaugcguacauguagauuucaauugucuuuucaauaagguaugugauaugaguuacucuuacuaauuguguuuucucucaauuuccuuuucucaacaacuguaucuuccuugacauaccuguuaguagcaguuauacucacaguugaguuauacugagaauuuguugacuaguuuucaucaguggaucauguaguaaugcguauuaggauggagagaacuuagaagagugauacuguaaagcuaguacugaauuugaaguccaagagcauagguuuagguucugacucaauuaguuauuaguuaugugaauaagggcagaucaguucauuuuacugagacucaguuuuagagagacagaguaguuuaauacgauaguuuccaauucuagcaacauaucagaauuauccaagaauuaaaaaaaaauuuauagauacccaggagauucagauucuguagguccagagugggaccugggaauaaauugaggcaauuggacccaucuuuaaggcccccuacaauuuuccaauauuauaauccugcagggcagacugguagguuagcgcacuauuuucuucaccuccaucaucuacagguugccuugugcugucacaagaaaccaagaaagaucauagauccaacugagaacaaaucagagauaaaauacuggcauggguuaaaccauacaagagaggaauuuaggguaacugauuggacaagggaugaaaggucccuagaaaaggcagauuagaggacagcagaaaaugaacaacuggacuucauuauaugacauguuuuauuuccuuuaugaggggaugugagcaucugacccuuggcugcuucuguuguuuuaagaugaaaguguuaaagaaaaguagaaauauaugagaauauuuguauuucauauuauucaagaaagacauuaaagaaguuaauaugagacuaaauauugaaugcauaaaauuucucuguaauacugcuuauucacuguacuaaacucagugaaagguaaguccacuuaucuccuagaucuuauccaagaucaaguaugguuucaguucuguaaaagcaaaggcagagcuacauggcuccuucauguuacaaacuucuaaaguaauuacaacauaaauauuuugaggguauuuuugcuuuuugcuaaaagaaucuggacaugaaguucuuugaguaaagauuuuuaaauucuaacauuguuaguuuguaauaaaauguauuguuucuaagggagaaaccuuugaaguuccagaaauugugccauuucgccugacucauaauaugguuaauggaauggguccuaugggaacagagggucuuuuucgaagagcaugugaaguuacaaugaggcugaugcgugaucagcgagagccuuuaaugagguaaucaccuauacuuuguaaauaauuuaacaguaaccucgaauauaauuauuggccccuacauauguuuguuuuuauguagaaaccacuuuguacugacugaaauaguuuuuuuaaauaauagcuuuaugcagauauaauuuauauaccauaaauucaccccuuuaaaaguacauaauucagugguuuuuaguauauucacaagauugugcauccauuaccacuaucuaauuuuaaaacauuuucaucagcccaaaaagaaauuccguaggcauuagcagucacuccugaucccuucccccucccaccccugcuaucuacuuguaaccacucauuuauaauauuuucugucucuauggauuuaccuauucaggacauuucauauaaauggaaucaucuaauauguggccuuuuguguuugucuucuuucacuuaauguaauauuuucaguguucaucauguaucaguacuucauuguuuuuuauugccaaaugguauccuguuauauggauauacuacauuuucuuuuucuguucaucaguuaagagacauuuggauuguuuccaccuuuuguguauuauaaauaguguggcugugaacauugugcacaaguuuuauguggacauauguuuucaguucucuuguguauaccugggaguggaauugcugggucauauguuaaaugcuguacuuaacauuuugaagaacucucaaaucauuuuccaaagcaguuguaacacuuuauaaucccacuaguaauguauguggguuucaacuucucugcaucuuuucuaucuuuagauaacaucuuuaucuauccugguuauugucugccuuuuuuauuuuagccauucuagggaugugaaguuguaucucauugugguuuuaauuugcacuucccuaaugaccagugauggugagcaucuuuucaugucuuuguuggccauuuguagaucaucuuuggacaaaugucuauugaaauccuuugcccacuuuuaaauuggguuuuuuuauucuuuuuuuuuuuccuuugagacaggguuucgcucugucacccagucuggagugcaguggcgugaucuuggcucacugcaacaucugccuccuggguucaaacgauucucgugccucagcuuccuaaguagcugggacagcaugugugcaugagccacuaugucuggcugauucuugcauuuuuaguagagauuggguuuuaccacguuggccaggcuggucuugaacuccugaccucaagugauccucccaccuuggccucccaaagugcugggauuauaggcaugagccaccaugccuggccuauucuugaguugcaagaguuuguuucuuuguuugagacagagucgcccaggcuggagugcaguaacgugaucuccacucacugcaaccuccgcuucguggguucaagugauuucccugccucagccuccccagcagagaagggguuuugccauguugcccagacuggucuugaacucguaagcucaagccauccaccuuccucagccucccaaagugcugggauuacaggcaugagccaccccgcccagccaaguugcaagaguucuuuacacauuuuggauacaagaccuuuuaagauaugauuuucaaauauuuucuuccaucuguggguugucucuucacuuucuuugaugauggccuuugaaacauaaaaguuuuaaauuuugaugcagucuaauuuguuuuuuucuucugguuauuuuugguguuucuguugucauaucuaagaaacuauucccuaauccaaagucaugaagauuuacaccuauguguucuucuaagcauuuuugacuuuuagcucugcuauuuaaaucuuuuaucugucuucaguuauuuuguagauaugguguaagguagggguccauauucauuuuuuugcaugugcauauccauuagucacagcaccauuuuuugaaaagaauauuuugccccucguuuaauuaucuuggcuuuuuuguugaaauggucaauugauuuucagcaauauucuguugaucuauaugccuaaccuuaugcuaacaacacaguguuuugauuguuguaccuuuguaguaaauuuugaaaucauaaagugugaguguuccaacuuugcuuuuuuucccccaagaucauuuagcuauuaugggucccuuguauuuccauauuaauuuuaaaaucagcuuggauuuugauaggaaggacauugaauuuguaaaucaauuagggaguauugcugucuuaacaauuugggaguauugcugucuuaaccauguuaagucuucugaucgaugaacauagaauguuuuuccauuuauuugaauuuuauuuuuuucaucaauguuuugugguuuuuagggucaaguuuuauauuuaacuuuuaaaaauuguauuccuaaguauuuuauuccuuuugauuuuauucuaaauggaauuuuucuuaauuucauuuuuggauuguucauugcuagugcauagauauauaauugauauuuauauauugauauuguaucuuacaaucugcugaauucauguauuaguucuaauaauuauuuuugugccuuccuuaagauuuucucuccacaauaacaugucaccugcagauacaguuuuucuucuuccuuuuuaauaucaaugccuuuuauuucuuuuucuugccuacuugcccuaacuaaaucagugucgaauagacaugcuaaaaguggacauccuugucuuguuccugaucuuagggguagagcagucagucuuugacuuuuaaguaugauguuagcugugggaaacagauuguuugaaaggacuuuuaaagcuuauuuauucaccuucauuauuuaaaagcugucuaucgggccgggcgcgguggcucacgccuguaaucccagcacuuugggaggccgaggcgggcggaucacgaggucaggagaucaagaccauccuggcuaacacggugaaacccugucucuacuaaaaauacaaaaaauuagccgggcgagguggcgggcgccuguagucccagcuacucgggaggcugaggcaggagaauggcgugaaccccagggggcggagccugcagugagccgagauugcgccacugcacuccagccugggcgacagcgagacuccgucucaaaaaaaaaaaaaaaaaaaaaaagcugucuaucagacauuaugguagaauacugguuaguuggacauaugcaaaagcaaauucucugaaauaggaaguauaucaucauguggaacaguuaccaagagccccuguguuagucugggucagucaagaaauaauuucuggaggaaguaguugagaccuuaaaaguuaauaaaguugaccaugcaagggagaagagaguguucugagugauaaaaauaucaaggcaagugaagucauggccugccugagaaauacaguauguauuccagaggguauacuuccaggagguggugcuaagagaugacgcaggacagguaagcaggggcuagauuaugaaggucucacauggggccuguuacuacauuauaacuuugccugcagagcaaccagaagucauugaggauuuuaagaaggaauaaaaagggggcaagggguggaaagagauaaucugauuuguacuguagaaaaaauaggguccuaguuugggccaacagccagaaaacuaguuagagguuuauugcaguaacccaggaaaggaugaugguguacuggauagugucacggccguagagacggagauaacugaagagauuccaaagagauuuaggaguuguaauugcauguuagaggaagacggggugaggaugauuccuagauuuuugucuagggcaaauggguggaugaugauuuggggaauacaggagaaauaguugggaaaagguaauuaauuuuauuuuggagauacugaguuugagguguuuggaacauauccaacuggguauuucccauagguaauuggauuugauguuuagggugcagaaaaaaggucugggcuaggucuauaugguagcuauagauguuauaucguuauugaagacaugguaagggauaaaauuccuucauucaaaauauagucauuuaccaguucacaguauacacuuagagauggcacauagaacccaucuuacucuauucuccaaaacaccucugacuccccucuaucuugccuuuuuuccugccuucccuucucuuacccuccccucacaccaaaacagaaauuucacauaacuuaaugaagacguaguaauguguauuauaagaguauuaccauuagcuucucauccuucacuuaaauauugaugucagcaagauuucuucuugcaaagauaacaucauaccauaauauuuguuucaauuuuagugucuuaaagacuuuucuacaugauccucuuguggaauggaguaaaccagugaaagggcauuccaaagcgccacugaaugaaacuggagaaguugucaaugaaaagguuaguagaagguauagcuugauaugggcuguaguccucaucucuacaaaugaacuugauaugcagcuauaguucucaucucuaugcaugagaacugcuuggaaauacuguuagugacuauugauuacucugaaaucuaguucucuaguaucacaaugccauaaguuuucuuuauugucaguaauguuaacaguauucgcauuuguauaauaaaaguucauggcacacuuguuuaaccauagacaauucacaguuaugagauacaguaggaaaaacuauaguacaaauugccugaacuuacagaacaacaggucugagcuuuaauaucaugauaccaguaugucacaagcuauguuaacaaaugcagcaauucacuucuuacuuaguugaagcugcaaaguuugcagauaguuuuguuguuguuguugugguggugguggugguuguuguuuuugagacagagucucgcucugucauccaggcuggaguacaguggcacgaucuuggcucacggcaaccucugccuccuggguucaagcaguucuccugccuuagccucccaaguagcugggauuauaagcgugcaccaccacagcuggcuaauuauuauauuuuuaguagagauggguuucaccauguuggccaggcuggucuugaaccccuggcuucaagugauccacccaccucagcaucccaaaaugcagggauuauaggcauaagccacugugccuagcucagauaguuguuuuuaauaaguuagaauagauugaggauucguuuuuuuugguggggggcacucuuacaucuuuaauaagucuuguacaggcuuacuaaauacaaugaauuauaccaacuauaugcuaauaaagauuaaaaauuuacauuccaguuaacuaccuaaagaguuuaaguccacuuucauccuacugauauagcucgaggaaggcuagaccuguacgcccccauccuucaugucauccuuaacccuuugucuugagaaagaagguuuagcugcuucuuuaguucuucuaaaagaacuaaaagaaaaauuucuuuuucuugcucuauuaucuucaucuguagggugagauuaauauuuccagaauuguggaaaaauucacucuguagcaguugaagagcagauggucucugggacauguuccuuuucguuaagugauagauauacuuggcuuguacuggauaccuuuuacugagggauuccaauaucugaccaguucuugaaccuguuaaaacuucugcucgcuccauuucuguucuaaacagcugaaagagcucuagcaggaucacacucaagcuauauacauaucuaacuggacaaagccagcccuggucucuacaaauaguuuuuguuuuuuuuuaauuagcugggcucaguggcacacuccuguagucccagcuacuugggaggcugaggugggaggaucacuugaccccaggaguuggaggcugcugugagcuaugaugacaccacugcacuccagccugggcaacagagugagacccuuggcaucauacucagauccuuccaacugcugggaugaagcauacagacaagugcccacucuggauauagguguugguguucucuuucuguuucuauggguccagucuguguucuuuuguaagaugucugggcaagccagaccaaagucuccuauuuuuacuugcugaucagggccaugaagaaaaauauuucuaggcuucagaucucuguuuacaauacccauguuauguauguaaaacacaccuuccacuaaaucuugaaaauuuuuuguugcaacacuggccauaaggacaggcaaacuugcccacacacucuuggcccuguuuguuucucucagcuagccagucccacagcuggagcuugcacaccugcaucuggaugugcagcaucaggugguacugcaccucgauccccaacaaguugaaguuuucuuuggaagauuccucaguggaugugaaauucuccucuaggagggaauuacaccugagcagcaggggcuguuucacaauugaccagguagacaaaccagccaggccauuuuccuggagcuccagggaugauucauauucacuggugucucuuaagacggaauugaugguguaguucacagcuuguuguucugauuuugagugucagauucugcaaaggguuuuucuuuucugaggugagcuccgcgaagauaaugggugagcugcuauuuucaccauuuuuaacaccguauugguaucugucugcuuggucggagaacacuuccagaaauggcaacugaacggaagcucugucugcuugugguuggaccacuugaacauguucuguccacgcagugugauaacgaaugauauuagggugcugaagaccugccagcaccuucauuccccguaguucuuucauguaauguguuuuuguugcacccuuaaucaggauuuuuuaaauugcauaauacugaccaucuaauuuauuccugaccuuguauacucuuccauauccaccuuuuccuaagauggcaaguucuucaaauucauuuaaguaacgugaaguuugugcuucaaaggguacuucccuugaucugauuuucuggauaugagaaauagccucacaaggauccugaugaacucucucuuuaguggaccucauuaagugaguaauagcucuguggugauguagucucaaugagcuaaacuugucacaagugaaagaagacagcagccccauuuugauaaaggucuggcaaaguaacuuaaacacugucuugaaugaacuggguuugguucacgcacauggcucaagugcuucaccaaagaaauaagcggcagcugguuugcaacugcaaaagggaaaguuggcuguuguagggguuauuuuaauaccuggaguucugcuggaacauaagucauauuuggaguccaggcucuuggcggaaaagucgauggcagauggcacagcaacagucuccaccccguggcccuccucuuugugcucgugggcugcagcgcagcccaccagcccacccagcaccaccucugagaauuauucuucuaauaacguuauucuuccuuuugcauucagauaugcuuaagaaauuguacaguuccaaguagcucacuuagaacacccauuugcauguacuaacauaauguaaauauuaggcaguacagcauuguuauuugaauauucauugaaauguuuaaguccuaaacacuuccaaagcagauuuaaaaaauuauuuuucuagaauuguaauguguaaauaauucccugguauuucacguaguccagaaacauguccaagcaguugauguugaaucaaucuugcgagccuccaaaucaguaucacaagcuaacuguauuuguuuaauuucuucuuuuccuguauuugcucuuacaaaagggguauuggucaguaaaaugguauuaacauuuauuaaaugucaaaauauaaagaaagguaguaauuccaaauuauuaacaucuguuuuugguuuuauguuucuucuuuuuaggccaagacccauguucuugacauugagcagcgacuacaagguguaaucaagacucgaaauagagugacaggacugccguuaucuauugaaggacaugugcauuaccuuauacaggaagcuacugaugaaaacuuacuaugccagauguaucuugguuggacuccauauaugugaaaugaaauuauguaaaagaauauguuaauaaucuaaaaguaaugcauuugguaugaaucugugguuguaucuguucaauucuaaaguacaacauaaauuuacguucucagcaacuguuauuucucucugaucauuaauuauauguaaaauaauauacauucaguuauuaagaaauaaacugcuuucuuaauaca

SEQ ID NO: 193028 - RNA, 12169 nt, Homo sapiens
ugaggguggaggugggggcgaucuuuauuguggcggugggugggagggggguucccacgugagcccuggugcuauagagagccggccguccuccaggggugagcuggggaggcuucugcgguucuggagucccggcgauggcgccaguuccccagcaaacccccuccagagcugcccccggaugcacagacaaggagggggcuugggagugacuugaggcugugacggggucgcccucggugugggcaagugaguccucuguggccaagaggucagagucgucccugaggcugagucgaacacagacccguggcccucauaaaauuaaacauaaaagcacaaaaauggcgcaaccagacagcauuggcuucagacaggcaggacacggggccccucgugugaccugugacuuuccacaaagggcaaggaccuggcacugacuccggccaguggagaaggcugugccgcccacccggccaugacucagacccagaggcugaaagccacagacggggccgcagggcagcagcucccgggcucucgugaaacacuucagaaggaaaaaaaccuaaggaacagaauccugaauggagaaaacccaacuuuuuuaaaaaagaaggaaguguaugaugggaaucuacgggguggguuuucuuuaagaggugagaacuuggaaucuugcaagcacugggaguggacuccggcggcggcgcagacguggagcagggagcguccucgggccaccuguggacagggaggggcgcucagacuggacccaccucccagcgacccacaggcgggacccaggagcccacaccuggcuagcagaucccgcccaccacaccuggcucaggaguucccgcccacccacccaccacaccuggcucaggaggagcucccgcccaccgcaccugccucaggaagaguuccucuggcggacguucuugccuuugucauucuggugcugcccgcugcucuuccuggggcacgaggggccgggugagagggugucccccgcaagucacucucuccaagucaccccugcccaccccggcccccaggacccccgaauacugaagcccaggggcucugccuuuguguuuuaaaggccuggggcagcaggccgcuccuugggacccccgacccccacagcuggaacuuacaggggugcagagccggcgucgucaucugaagaaggaccgccgccaugaaaaagaggacgagaggacagccugucagcacuggccccacucaggccccgagcaggggcaucugugcugccagcccugcccucagugacccccagggguggcucggggcagcucaucagccccggccacgugcaucuucugagugcuguggggaaaggcagcccuccccaccugcaggugugcuccccauggugagcuguccccauggccucgugggccucaccccugccccacagcguuuuccaggagcugccaucacaggccccacacaggccucgccccggcacacgcagcccaaggggcagaagggcuccgcgaggaggcaggcaggggcugccggagcacagcauggcugaccucagguucccgagccugaucaugcagagcagcaagggccggcucaccacggaggacacuggcuugcagccaagugagcgggagggaagggccgggugaggcuguggggcggaggugccgccuccuccucccggggucccgcugcccacugagccgcagcugcccggggcuagacccuccaucccacacuuucuuucggggucccaucaacucccugccuggggcuccucaguuccaagcucugggucagcgguggggcuggcagggacggaccaggaguggcccugggccaccccgagagcagggcaugugggcaggagggcagacggcucaccauccaggacguccucgggcuuccggcgcuucucguagaugaagaugauggugaccagcaccagcaccucagccacgaugcccaggaagggccagagggcggccagguggcugcgcacgcggagcgugaugauggccuggucggagcccuuggagcuggugccguugcaccgguacuggccggggucggccuccauguucagguucucaauguguagcucugaccggcccugcgaggaacucacgaagaaccugcucucggagccguucaugagggccuaggggaccaaaggcaagggcugaguccaggacccccagucuaggccccucacccaguccugagggcugaguccgggacccccagucuaggccccucacccaguccggagggcugaguccgggacccccagucuaggccccucacccaguccggagggcuggguccgggacccccagucuaggccccucacccaguccugagggcuggguccgggacccccagucuaggccccucacccagucuggagggcugcaguccagagggcuggguccgggacccccagucuaggccccucacccaguccggagggcuggguccgggacccccagucuaggccccucacccaguccggagggcuggguccgggacccccagucuaggccccucacccaguccugagggcuggguccgggacccccagucuaggccccucacccaguccugagggcuggguccgggacccccagucuaggccucucacccaguccugagggcuggguccaggacccccagccuccuuggcuucucaccuuguccucagagucagugaucuuguaccaggcccagucagugacagguggcacggacucugacuugcagaccagcauggccgucucccccucguugauguguucugacgacuucacagccuucacucugggaggcccugacaggagggugagagagaggagccuggaaccgcaggcccgcccccauccccggccucccgcaggagggcuguuccccuccagggagcagggggccagggcucugggaugugccgggugccucaggccaacaacuucucccgacagucgguggugcccgguaccccuggcugcaggacucaccguggagcuggauguuggccgugcccaugggcucggggaggaagacgcaggaguacucuccccacuggucgucggaguccacccugcaaccacagcaggcaggugagccgcguaccagcucugcaggacgccuccaaggacccaggguucuccaggggcccaaccacggcacagugaaaaagcaaaacugucccagucaagucugaaccucaaaagaacuccugggguccccgugcggccccaaggacagagccaggcuggcaagaccccacaggugagagaaccaacagacccccuucuccccgacugaugaaccccacaccucuggucccugcucugcaccccacacccugugaccgucuucccagucagccugaaaacaaaaggcucugugcucccagggccgucccagccccaguuaugacaaagcuccggccaugacagcgucugggguccgagcagggcaugccucaguguggugcccucuugugccaggagcacagagccugggaggcccgcacacgugcccgggaccuggcaguguggcgcccuuucgugcccgggaccuagugaggagcaagcaauggggacuccugccagggcugcuggagcccccugccucacaaggacgccccucagaccccucccugggguuucccucugggggucugcgcggagcuggucccuaacuuccgccuggaucaagccugccgaccggucuuuuguucucacggaccacaggccgcuggcggcaagagagccgugagaaggggcagguggcggcauggcguggucaggcacucacuugaacuccguuuucuggccgggcagcgcguccuccuucagcaccacgccccccuucagccagcggugcccugugaccucuguggcgcugucauucaaggagcaggugaggaguaucuuggagccaaggucuucuacgguagugaagacugugccggcugcaaggcccggcgagacgcggucagcagaguggaggagcacggcccgcgcugccugccugacccccaggaaccugcggcuccuccccgggaaggacugguuuucaucccaaaaauacaccguggcccuuacgccccgaggaccggaggcccaaggggaacuucuggccacgccuccgggaagggaagagcccagcgccugcugaggaggccccuucgggaaggcacccccuucgggaaggcacccuucgcuggcagcuggcgggcccugggcuaaggcgcugggaacccagaggccccgccuggcgauguuccugcccagagacacacgaggcugggaccaggguguggggacagacaaggcacccacccacgucccugagcagggaccagggcaucgagcucuuguagcagccccagcacaaacuggaaauucuuuucuaaaaacguagccagcugggcgcggugguggccgggcgcggaggcucacgccuguaaucccagcacuuugggaggccaaggcggguggaucucgaggucgggagaucgagaccauccuggcuaacacggugaaaccccgucucuucuaaaaauacaaaaaauuagcugggcauguuggcucaugccuguaaucccagcuacucaggaggcugaggcagaagaaucgcuugaacccgggaggcggaaguugcagugagccgagauugugccaccacacuccaccugggaacagcaagacuccaucuccaggaaaaaaaaaaaaaauagccacagcacccccggccaaggcucccgugcccuucucuaggaggcacucagguggccccacauccccccagccccaggcugacggcacuccagcagugcugggagcaccccgguucuucugccaauccccaaccaagcaaaucucuugguucuugguuaguuuacaauauucccgcuaggaauugaaauuugaaaaucccuuagaacgagaugcugcgaaggacacagaagguucugagaccugcaagccugggcugagcuuggagggccccucaggcuugcaguauggacgcucagggagggagccgggcaggcgcccggggaagcagaaacgacggaacggauggcacgagggucgaggggaggacgaggacccaccugcuggagggcagagcccugccugccccgagccaggccgcccagcgcugguggucaggcggcgagcccacccccuucagguccgggccccuccguccaggcggugggcccaacggggcacagcgggacggagaggggaggaggcgucuggguucuacugagcaggagccgggaggcgagcggcacaggagggaaacugagggaggcggggagggaggugcccgccacucacguuccaggacuagcacgacugccugggcgcggacccacuugacccugggcgcccgggucaggugguugcgauccgggucguugcuggcccggcacucguaagugcccguguccuccuccacgagcgugucgauggagauggugcuggccgcgugcuggugguagguggcguggauguggacgcgguccagccgggcgccgucccagagcugggagcaggugucguugggacccugcccuucaaaccaccacuggaucucgggcaccgggcugcccacggccucgcagugcagcuccacacugccccccacccaccucugcugggacagcggcgccuggacgaagccggcuguggggagagcacgcguggggucuuguuagugccuggggcacuugggagggcagcuccuggggaaggccucgcccacaggacucccagccagggcugguggagaagccacuuccuuucagcuugugggagagugauggggcccggcuggaaacagcauggcaugggaaagaccgugggcgucccguccacugcuaccucacggcagccacggcggcuucugagggcacaacugugggaccacacgugguuucaaaacacaaaacacaugaaacugggcagaagagccaggaguccugagccccgagggcugcccagagcucaggucccaagcgcaccguccucugacuucugcccgauacccugaccccagagacccgggugagcugcugagaaaaacaaaccccaaagcccaaaggggcaggcggccucuguccagaagccccuagcccggcuccguuaggacagcccguggguggaaagcucguguccucagcaaucucugagggcggcgacccagagagaggcggauuugggaagcugggagccaggcagggccucagggccucucaccuccagccacacgccuccccuuccuucgaaaugcaagggaaggcccccagagcugccaaggagcacagcagaauccacacagaaccucacacugugccuagcacucgccugccaggaacagcccagcccaaggggaagcguggggagugccuccucccgccaggaccuugcagcccuccccacagcaccuucugaggucagacuccccaggcaccgcuacaacacacacacacacacaaggacacacgucugcaaacacacacaacacauacacacgugcauaugcgugcacacggcuccgaggcugcguggcagugcacaggucacggcccccaaggccacggggacaggaauguucacgucugagcaccucaggugagcucugggcaggcgcaguugacaaguuuuggcagcgccauuuucuuucuccucuucuucuuuuuuuuuuuuuugagacagagucucacucuguucagcagugguguaaucucagcucaccgcaaccucugccucccggguucaagcaauucuccugccucagccucccaaguagcugggauuacaggugccugccaccacacucagcuaauauuuuguauuuuuaguagagacgggguuucaccauuuuggccaggcugguauugaaccccugaccucgugauccacccucuugggccucccaaagugcugggauuacaggcgugagccaccgcgccuggcuggcagugccauuuucacaaagggaucuccuccugguaaccuacauuucuugggaguuaagauuucccagacugcaacacuggcagcuaugugcagagcugggcgaggugagucagggcaggaagcacagccagaggcugcccagcuggcaagcuccuuccugcccugcagcagccccucuccucauccuccagaccugcagggcugggcuccacauccuccucacccaggggugcuaggagagggcuggccccugacucaccucaccccaccuccaggcagggcagggcacacaggaaagugaggaggaccagguggggcccgcagccgagcugcccccagccaccuuuccaggagucccgggcucccaggcgccaucugcaccggucccggugcucccgcuggguccgccagcuucucagcgggcagcaucgcucccaaagggaccaaaaggcuuuggauggaacaacccugugucccuccggaugcugaugaugcuggugucuguguauugacgugucacugggggugggggggcguccggaagagaaagccuccauagaggcuccucggggacaaugcagagcgcccccaccccacggaccaccccaucucgcccgccgcaccaggagccuccacccaugagcagcaggaggagggacggcgccugacccucggccacagccccagaaagguuagaauucgauucuggccacaugagacguaacccauguucucaaguaaagucaccuucaucuaaaaacagccuccgccuccuugcccagggcucagggccaggcaggccgcgugguacuuguacacaagcagccccgcaggauaaggcugcccgcccccacccgcccuccuccccacccaccccagugcucagacagcagccagcgagaacagcucugggaagcagccucgggcaccucccccacccacccccaccggccgcagccaggcacucccacuccucucaucugaggcucgggggugaagcccuccacccucgggacccagcuagcacaccccggcccuccgguccccgacaagcccacaggagacgcggacggccaaccuugggcacucaccccacccggcugugccccaccaacccgcagacgccccugaagcaaguuucaggagaggcaaacacagucacgaauucacagagcaaacagcaguguccaccccacacgggccaaggcuguguugcccagaccuuguggucuucacgagucaguccccagcaaaagugggguuucucaccacacacacacacgcgcacacacggcuacaccgcugcacggcggcgcugccagcacugcagacuccaccugcuucccaggcugcaggcagcucuggccaguaagccccaggcuaagcuuucugcucagaagaaacccuucucagucuccugcacaaaugcacaaaaggaacaaaacugugaaccacccuacccagcagggagagaccaaaggucuuucacccacuuggcuguccaaauuagcucaaugugggaaccucgugcugugcuugaaacccagucaggccuggcuggguuuccacagggcuggcgggggcggcuuaucuuccgcgcucaccucacccaugggcuccuaucugugucuccccagagagcuggccgcagugcuggggccaggcccuugcccaggagacauucgauaaagggccacuuugguuaccaggaagacgaaaucucagacguaggucaggaguuagcuggcaaagccucuggaagaaggagcccccuccccagccucugcccaaggcccccuacggcucaaugcccaggacagaggcucgaagcccuugcucuugacccuucaggaggccagacccuccagcucugcaccuuguucccaacacaucggucacaauaaauuuuuuuuuuguuuuuuuuugagacggggucucgcucugucgcccaggcuggagugcaauggcgcgaucucggcucacugcaagcuccgccucccugguucacaccauucuccugccucagacucccuagcagcugggacuacaggcgcccgccaccacgccaggcuaauuuuuuguauuuuuaguagagacgggguuucaccguguuagccacgauggucuugaucucuugaccucgugauccgcccgccucggccucccaaagugcugggauuacaggcgugagccaccaugcccgaccucuuuuuuuuuuuuuuuuaaagacagagucucccuguuacccaggcuggagugcaguggcaugauaucagcucacugcaaccuucaccucccagguucaagcgauucucuugccucagcuuccugaguggcugggauuacaggcgugcgccaacacgcccagcuaauuuuuguauuuuuaguagagaugggguuucaccauguuggccaggcuggucuugaacuccugaccucaggugauccacccgccucagccucccaaagugcugggauuacaggugugagccaccacgcccggccucacuauaaaucuuuaacccagaaccaaaugggggucucaacaaaggaagaaauuuucuaugaagcaagaaaggaugucaugcuuuucucccggaaaaacacaccucaauccauuucccaaaugcgcucuccaaaccacguuugcccacccucaacacacggcccuccuaagacagcacuggaaaccgaaugcgggucagagucggcuaaaaacgacuuucucacuauuuccugcgcugaaucggguggccagggcccccucacugugaccuuggaaccucgacuucccacagggcuguuuccucgccuguaaaggaggaggggcguucagagaccaccucauucugggugcugaauccaggcagaaucagagggagauuccgccuucccuuccacgcagggccccucgagggagccugcgaggucuuaagagucugggagaacacccgggggcaggugcacgcccuaggcaagacgccagggcuaaaucccgugaagaacgguaaucccuucccgauccggagggcugacccacucagagccuccaugugcucuuggaggacaaaagccccuuuuccagaagggagcgccaagaugaucgcuccaggccgcacgggcccuugcgggggccccagagagucucaggggagggucucugacccuaacacucgcaggcaggguggacccgucuccagauuccacgcccaggccgcuuuccccagguccugcggaguccagccccagcaggacggguugggcaggcaccaaccagccccugaccccuggcuccaggccaaaggggacgcucacccaggcuuugggucucccuucuccuggccgaugggaccggcgggcgggccaccuccaaccgccuucgcagacgcccucacccaggaagcaggucacccccaaccccaggugaccgaaaagcaagacgcccaccuccccugaccaagaccggccuggccaggacccccuggcucccgccuccaagcagggagcuucacgcccacacacagaggccgggcucgaggccggagcgcccgggggagcccggcaggccgcgccgggaggaaccucuaguccccccucaaacccugggacuucacccccaagcuccaugcuggcgcgggaagcccccggggccggccuuucgcaccccaggccgccccgcgccgaggccccaggcucccgucggcuucgggucggcaccgcggccuccauucccggccccugcaggaccgcacccccgcccccuacccgcuccucaccagccccggaggcuccgugggugcccagcagcgcgaaucccagcagcacgaacagcgcagccgccaugauuccuauuccucgccgguccuacaaccuccaaccgcugccgccgccgcccgcggccgcuauaaaaagcggcggaggcgcggaccgggcgcgcgcacgcacggcgucaucucgggggcggggcgagcgccggggacgccggucgccccgccugcgcacgcgcgcacacgcucgcauguacgcgccggcuccggcaggcucacgcuacggaauccgggcggcggcgcacgugacccggcguugcuaggaaacgggaguggggccugcggggacgcggcuggagccugcgcauuucuuccuuccugcuuucaaaguugcaaugagcgcagagcggugcgcccgaggggguugaagcguugaaaguguguuacccagauuuuaucugaguuaaacacgggccggccgcuguggcucacgucuguacucccagagccuugggaggucgaggcgggaagaucgcuugagcccgggagcucgagaccagacgcggcaacauggcgagacgcacaucucugccuuuaaaaauguacauauauauauauauauaugaacguauuaauaaauuaggugggaggaagugaccuccuccgcccaaauaaaaauacuuaaagggcacuugaaucuggaucucagaaaaugaauaauuucuuaguauaaacguccugugcaccauuugguugggacaaguaaguuccucuucagaaacucaacuuccaggucuaaaguugucaaucaaccuuacccccuucuucuuuccucgcagguggcgcguuuacccuauuuuaaaaaaguuuuaaguuuuagccaaccgggaucagcuuagauugugggcguccaaccccagccaacagggaaaggacagaggaacagaagcucccuuccuuugucccgugugcucuggagauugcaucccacgcaggcagcccccuuccguacaaguaaaguggucucgcugagaaauuuucuaagugcugguuucucuuugcgggaccgacucgccgcccccaaauaucccauuuggaucccauucuguuucaggagaggcuggcgguuaccuuucuuggggagacgcguccgacugcuucauugugggggccucaggagcggaggaucgggucccgcccgaggugacgcguaaacccagacucucagcaacgcggguaggaaggacccuugaaguuccgcggcgaccacggugagaaaagucgcuauuggggcgacacaggugggggcgucucuuggagguugaaaguguguguuggaaguuaaacucggagucgcaaugcaagaggaccgcagacuaagccgaa

SEQ ID NO: 193029 - RNA, 44437 nt, Homo sapiens
cggccgcggcgguagcgcggaaaacaauggggccggggcgguggggagaggccgaggcuugagguaggcagcaagcgccggcugggggucgggccgagcggggcaggaggaaaacccgccgccgcgcgcgagcccgcuccgcugcccucgggggcauggcgcggccgugaggcggagagggguagccgcggggagcgaagcccgcagugccagccggccccgagaggcccggccccgggcccggcccgugcagcccgcggcccauggugcugcccaccugccccauggcggaguucgcgcugccgcggcacagcgcggucauggagcgccuucgccggcgcaucgagcugugccggcgccaccacagcaccugcgaggcccgcuacgaggccgugucgcccgagcgccuggagcuggagcgccaacacaccuucgcccugcaccagcgcugcauccaggccaaggccaagcgcgccgggaagcacaggcagccgcccgccgccacggccccggcgcccgccgccccggccccgcgccuggacgccgcugacggccccgagcacggccgcccggccacggugaguagggcgcgggaaggcgcuugucguggcggcagcccccucucccgaaaacgcuuccucugacgcggaucgggccgcugggagacuuccccaggcguccgcgacuccuggaucuggcuggagagaggguaacauggcagggagcugagagguugucaucuuugggaaguggcacgguggcguuacuuugggaaaacagcgccuugagggccuugcaggaggcccgaccugggaaggcuggcgaacgcuaaccggaggguuuuucuuccagacuugauuccgggauguugagaucuuuauucgaaauagacuagcauucgagucgccugugauggagggaguuccugcaccguaggccuggccucauuuauucugcaaauguuuauuggguccuugcccuuuacaagauccugugcugugagcaggaucagggcuuucauguggaaauaagucggccuuugguugaccaacugaaacuccucugaauggaaaaucaagaaauuuuuggaaaacuuaguaaaauguucaaugaguugcauauaaguauuccuuguuuagguagccugaacuuugugaacuugagauuccugcaauauuguugacaauucuaguuuuaauuuaucaggccuguuuaaaaucucugaugauguuagauuguuggucaauuauuacucccuuugggcucucaguaaauguuccugaaauuuguugguuagagguuuuucuuccugaaacagauuuacaaaagagacaagguuuuucagugguuuucuuggggauuuuaguuuaaaaccaauguuaaaaucuaauuuguuauguguauuuuuaaauucauaccuuuauuaucucucaccugggcuauugcagugccugucccuagcuaacuaaccagucuguaggcauuuaguuucuuucucccuuauucucgaaaugcuggaaauccuucucuugcuugaaaggaugaaguucaaagucuuuaguuuggcauuugggaccagucugaccuaaccuaucuuuuaaugucccucacagguccucugcucugguugaauuauuuuucucauucucuuccacacuagccucgauugcuggguuagaagaaaaaaaaccacucagauuucauugcuuauuguaucaacuggucaagccuucucaucuucacuuuucucaucuguaaacuaggggcauguugggcuuauuaucgccccguguucuuucccugcccuccccucacucugucgcccaggcuggagugcagaggcacagucaugucucacugcagccucaaccuuccuggcucaagacuccucaauccucccgccucagccuccucaguccucccgccucagccuccugaguaacugggaucaaccacagcugcacaucaccaugccuggcuaaauaaaaaaaguuuuuuuucuguuagagauggggucucacuauauugccuaggcuggucuugaacuccugggcucaagugauccuuucuuccaacuugaucucugaaagugcugagauuauaggcaugagccaccgcaccgugccgcccccaggauucuuuuaagaauaaaaagaaaugaguguggacaugaaaauacaguauuucgggggaagggauagcauugggagauauaccuaaugcuagaugacgaguuagugggugcagcgcaccagcauggcacauguauacguauguaacuaaccugcacauuguacacauguacccuaaaacuuaaaguaugauaauaauaaauaaauaaauaaaauacaguauuucauaaauuuaaaggccgccugugggacccuccuccaucccuuucagaauccugccacccugccagucccagcuuaucucuuucuucugccuuaaagcuaguuccugaccagccuaacccacagcaguaagaaucuccuuugucaaaacauuuaggaaacauauuaucuaugcuauuuguuuuauuuauuuauuuauuuugagauggagucuugcccuguugcccaggcuggagugcaauggcgcgaucuagggucacagcaaucuccgccucccagguucaagugauucuccugccucagccucccuacuagcugggauuacaggugcuggccaccaugcccagcuaauaauuuuuguauuuuuaguagagaugggguuucaccauguugaccaggcuggucucgaacuccugaccucagauaauccacccaccucggccucccaaagugcugggauuacaggugugagccacugcaccuagccuauuuauuuuuuuuugagacagcgucucgcccugucacccaggcuggaguguagugacaugauuucugcucacugcaaccucugccuccccgguucaagcgauucuccugccucagcuuccugaguagcugggauuacaggcgcacacuaccacgcuuggcuuauuuugguauuuuuaguagagacaggguuucuccuuguugggcaggcuggucucgaaccccugaccucgugauccacccaccucggccucccaaagugcugggauuacaggcgugagccaccgcgcccggccuaugcuauuuauuuuuagcacauggucacuuguuacuuuaggucgcaucuuuucaacuagacugucagcucuuggaggcagggagggcucacacuuggguaguacacaucugaggugcaucuuaagugccuguuuguugaauuauugauagaaacuugguagugcuuuacucaguaaucucuccuccuauacacuaacuucaaaaagcaaguugauguaacuucaugagccaccuuucauggcucauaguaacaacucuuguaaggagggacuuuuguuauuuuuuuuuagggaguuucgcuuugucgccaggcuggagugcaauggugccaucuuggcucacugcaaccuccgccucccagguucaagcaauuccccugccucagccccccaaguagcugggacuacaggcuugugccaccacgcuccccuaauuuuuuguauuuuaguagagacgggguuucaccauguuggccaggauggucucgaucuccugaccuugugauccucccgcacuggccucccaaagugcugggauuacaggcaugagccgccacgcuuggccuguguaaggaaggacuuuuaagaguaguucguggucauugcaauugaaguaaauaaugaaagcucauaaaaaucauaguuuaauacacaaauaguugccuugaauccucccuagaaaguauauuaggggggccgggagcagugguugacuccuguaaucccagcacuuugggaggcagagguggguggaucgccugaggucaggaguucgagaccagccuggcuaacauggugaaaccccgucucuacuaaaaauacaaaaauuagcugggcauguggcgugcgccuguggucccagcuacacgggaggcugagggaggagaaucgcuggaaccugggagacggagguuacagugagcugagaucguaccacugcacuccagccugggcaacagagggagacuccgucucaaauuaaaaaaaaaaaaaaaagguauauuaguaaugauucaauuuuuguuuaaaguuguucuaagaauuuagacccuguaugauuuuuuuuaguccugagucagugggggaaacugggcaugcuguuugaagagaaauuaauucugaguguguuagaauuugaaucuaauuugucagucauuccuuuugauaucagagcuuaaucagaugugccauguuaaggugaugucuuuuuaucacauuaaaccuugacuuauggauuucuugaguuuaaacucuacgguggaugugcuuuucugugucucugcuaggaagagggacgcuuugcauuuggacuccaaguuagucuagcugagcucuuuggccuuggaauggggucaucggaacagaagauaaguaucauuaagaaaacaguggcuccuucaauucaggggggaagagaguccuugaguauguacgauuuuggcuuggagaaaacagcuuugcagaaagagauggaaagaagguaccucuuagucauuguuauuuuugacaacuccauguauuugaucucauuaauauuucuuacuuaaggaauauuauaaguucuuaaguuuuuuccaagugaacuauauacuguuuggcagucauuucauaguuacuucaccagcaacccauuuguaugacugagaagggaucagauuuacugcuagaguuuacuucacuucagauuauuguuuucuuaggauaucccaccacagcgaagucuuagccacuaucugcuuagucuguuagagaugaaucagaaacacuguuucaggcuuuuucucuauucuaauuuucaaggaaugagucuauuagguuuucauuucuuuuccuuuuuucuugaaacagggucuggcucuaucacccaguggcgcgaucguggggcacuacagccuugaacugcugggcuccagggguccucccaccucagccuccugaguagcugggacuacaggugugcaccaccgcacccggcuagguuuuaaaguuuuuuguagagaugggugugagccaccuugccuggccgaaaguugauuuucuuacuuaguuuuagguguguaaaguuucuuucucucuuuuuuaaccuuuuauuuguaaauaaugucaaacuuagagaaaagcucuaaguuugguacaaagaacaucugguuaccuagauuuaccuguugucacuguugugccccauuuguuaucauuugcacauucucucucucccacucucugccucuuucucucucucucagacuuuuauucucugaaccaccugagaguaugcugcacaccucauagcucucugcugccaaaccaccccauguguaccuuuuaagaguuaagaaagcuguuaauuuuguagaccaaacucuuguaagaauuaugaaauaacaaauuauuuccaggaaguagauauuucugaauauaaaacagauacuguacuguaaucauguggggcauuaguuuuuuuaaaaagaugaucaguguggcuuuaggaucucauuucuuccuguaaugccugagaccuugucuagaacccucuuuccuuuuuugucuucaguaucucccuucccaacugagucuuucccuucagcuugaaauuaugaacaaauauucuccacacugacaaguccuguguuuucucacugucaaaauaguauuccauauucuucuuucccuuugcccuucccacuugaacuucucauuuacucauuagccuaugguaauaugccuucuaccucuucuauuacucugaaguugccuccguaaaggacaccaaggauggacuugccaaauuuauuggcaucuuuuuuuuuuuuuuggagacagggucucacuguguugccuaggcuggagugcaguggcaccauuauggcucacuacagccucaaccucccaggcucaagugauccucccaccacagccuccucaguagcugggacuacaggcgugagccaccacacccagccucauuggcaucuuagucaucauucuucgugacuucuuccuuuucuuagcuucuccucucuucugauuuccuuuucagcuuucugacuuuuuuucucagucuccuuacuauuuucccuuauuaauucaugcagcaaauauuugagcaccugcugugggccagaguacaaucagcccuccguaucugcgcauucugcaucugcggauucaaccaacuguagauagaaaauauuuuuuggaaaaaaaaguaaaaaaauaacaguacaacaauuaacacaaauuauaauaugcagcucagcaugguggcucaugccuguaaucucagaacuuuugggaagcuguggugggaggauagcuugagcucaggaguuuuagaccaggcuuagcaauauaacaagacuccaucucucaaauagaauagaauagaacggaacggaacggaauagaauagaauagaaaaauaaaaauaaaaauauagcuggguaugguggcucacaccuguaauuccagcacuucaggaggccaaagcugguggauuucuugagcccaggaguucaagaccagccugagcagcauagugagaugucaucucuauaaaagcaugguggcaugcaucuguauucucagcuccucgggagaccgaaguaggaggauugcgugggaccgggagguaaaggcugcagcgagcuaugauugcgccacugcaccuuagccccugggugacauccaaacccugcaucaaaaauaaauaaaaaauaaaaauaugacaacauuuacauagcauuucuaucauacgaaguauuguaaguaaucuagaggugauuuaaaguauccuggaagauguguauauauuauugcaaauacuaggccauuuuauguaagggacuugagcauccuuggauuuuggugucccggcgaggcugggcaggggucuuagaaccaauuccccauggacaccaagggaacugcuguguacaguagcgaauaggacaaauuaaaauucugcugucauggagaaagaggaggucaauauuuuuguuaacuuuguuauaauaagugcuaagcaaaaauuaaaagcagagucaugugauacuaaaugacagucguagcuuaagaugccuugauuugagcuugaugauugagaggcugucagucagcugaaagucuuagaacauuccaguuagagagaaccaccaguaccaagugucugaguuaggacccuucugagcuggcaugaagaacagaaagcaggccagugugucuggagcagcguggcaccuaggaccagaucaagugcaguaggaagcaguagcaggauagggagcagaaacaugauaugauccaacuuagguuuuuuugcucugcugaccagucuggagugcaggggcgcaaucucagcucacuacaagcuccgccucccggguucacgccauuuuccugccucagccucccaaguagcugggacuacaggugcccgccaccacacccggcuaauuuuuuuguauuuuuuuuuuuaguagagacggguuucaccguguuagccaggauggucucuaucuccugaccucgugauccgcccaucucggccuccuaaagugcugggauuacaggugugagccacugugcccggccgaucuuuaaguuuuggaagaugguucuggugcuagguggaggaugccugggguugguguggauaggaguggaugcauauaaagcuuuuguagcucucuagaugccagggcuggggcuggugguagcaguggagauggagaagaggagauggguuuuggacaguuccugagggcagaggugacaggacuggguugcuggacuagauggcuuuguuuugcgggcaggagaggggaguauucaagggaaauuccuaguuuuauggcuugagaaacuuucuuugcacuuuaaaaauauuaguguucucuaggcaacuauaucccuggccauuuucacucuuuuuuuccccugggugauguuauugauucuuucauagcuucauuugucaccuguaauaauacucuucaaauccccaguccagaucugucuuccagauuucaaauccacauuuccagcugucugcuggacauuuucaucuuuccaggauauauuucccacauauccaaaauggacuuucccuuuuuccuaccaaaucauauguuccuucuaaguauuuucccuaacccagucauccagaguaaaaaccugggaauuuuccacuccuuuuccacaauucccagcguucaguuggugguucuuucaaccaacauugaaguccugcuggagccaggaaucgugguagauggugaaccuguaucgcggagccuaagugggagcagaugauacacaggucauugcaaagccgaguucagggcuaaagccugugagaauauugaggaagggggaugccuuuuuggugaaguuuggaaggcuuuaaagaauugacucuuggccaggcgugguggcucacgccuguaaucccagcacuuugagaggcugaggugggcggaucacuugagaucaggaguucaagggcagccuggccaaaauggugaaaccccgucucugguaaaaaauacaaaaauuagccgggcacgguagcauacaccuguaaucccaguuacucaggaggcugaggcaggauaaucacuugaacccaggaggucgagguugucgugagcugagauugugacaucguacuacagccuggguggcagagcgagacugucucaaaaaaaaaaaaaaaaaaaaagaauuuacuuuuaagguggaucuuaagcuuuagccagaugcuuuccccagagguguuccauggaacacuaauuucaugggcuguugaaaguuacaguggaacacauuugaggaacacugggcuaaacaauucuuuuucccucugagcaucugcacauauuggcuaaacaaauguauuuuauuuuuuaaauuuguuuuauugauuuauuuuuugagacagagucuccgucugucgccaggcuggagugcaguggggugaucucggcucacugcaaccuccaccuccuggguucaagcaauuuucccaccucagccucccaaguagcugaggcuaauuuuuuguauuuuuaguagagacgggguuucaccauguuugccagauuggucucgaacuccugaccucaggugauccacccgccucggucucccaaagugccgggauuacaggcgugagccaccgcaccuggccaacaaacuuaauuugcuuuauuaagaacauuuuuggccaggcacgguggcucaugccuguaaucccagcacuuugggaggccaaggcggguggaucaucugaggucaggaguuugagaccagucuggccaauauggugaaaccucaucucuacuaaaaauacaaaaauuagccggacguggugguacgugccuguaaucccagcuacucaggaggcugaggcaggggaaucccuagaaccugggcaccggagguugcagugagccgagaucgugacacugcacuccagcccaggcgacagagugagauuccaucucaaaauaaauaauaaaaaaaaaaccaacauuuuugccacauucagugucugacaccaguaaucccagcauuuugagaggcugagguggguggaucauuugaaaucaggaguucgagaccagccuggccaacauggugaaacccugucccuacuaaaaaaauaaaaauaaauuagcugggcgugacggcacacaccucuaaucccagguacuugggaggcugaggcaggaggcaggagaaucacuugaacccagaaggcggagguugcagugagcugaaauuguaccacugcacuccagcccaggugacagagcaagauuccaucuaaaaagaaagaacauuucaaaucuuuaauaugcggcuaugcaugaagacaugagcucuuaucaggugguauuuaauaggacuuugauuuccuuuagggcacuaagcaaaagcacuaguaguucuuugaauuugggacuuaaaggcaagaaggugaguuaggucaugaaaagccuuauauuugagacuggguguuuggacaaaauaauguugaaauacugugaaccccuucacacuuuuuuuuuuuuuuuuuuuuuuugagacagaguuucacuccuguugcccaggcuggagugcaauggcaccaucuuggcucacugcaaccuccaccucccggguucaagugauuccccugccucagccucccggguagcugggauuacaggcaggcaccaccaugccaggcuaauuuuguauuuuuauuagagaugggguuucuccauguuggucaggcuggucucgaacucccggccucaggugauccgccugccuccgccucccaaagugcugggauuacaggcgugagccaccaugcccgacccccugccccacgcuuuuuuuuuuuuuuuuuuuuuuaagagagucucacugugucucccaggcuggagggcaguggugugaucucggcucacugcaagcuccaccucccagguucacgccauucuucugccucagccucccaaguagcugggacuacaggcgcccaccaccacgcccggcuaauuuuuuuuuuguauuuuuaguagagacggaguuucaccuuguuagccagccucgaucuccuaaccuugcgauccacccgccucagccucucaaagugcugggauuacagaugugagccacugcgcccggcccucgcucacacauuuuuaaguugacaccuagcacuuuucaucuuaaguuuuuaagcuuaugaaaacuuauaaugcauuuuuuuguuuaucaauuguaaacuaaguuaccauaauucaauuuuauuaaauuaaauauaugaaauaauacauuuagguaacagucuuauaauugcuacauauauuuaauuugaaucaacucuuuuaaaagaaggugcuauuuauaguugcaggguauauaacuuccagagaauuauaaauauuaucauuuaaaaauaaaaugguuacaucaguuuuuaaaauguagccaguggaauccgaauaucuuagcgauaugcuaucuuucaucaacuguuuaaagaaugcuuuaacagaaauuuuaaauuccuuuuucuccuggaacuugcauucuuuuuacacuuagcccacauaauauguuuuauuuuaacguaauauauguuuggaagccuuuuauuuaucauucuagcacauuucuuugcaacaaaaagagguauaaaaaauuaaauuuuuuuucuucuucaagauggagucuugcucuguugcccaggcuggagugcaguggcauggucuuggcucaccgcaaccuccacucccccggguuuaagcaguucuccugccucagcuuccggaguagcugggauuacaggcaccugccaccacgccugucuuaauuuuuguauuuuuaguagagaugggguuucacaauguuggccaggcuggucuugaaccuccugaccucaugauccaccugccucggccuccuaaagugcugggauuacaagcgugagccaccacaccuggccaaaauaaaaauuuuaaauuuacuuucaccauuaagcuggauccuuuuggcaggauuuuuuuuuuuuuuuuagacggagucucacucugucucccagacuggaaugugguggcacgaucuuggcucacugcaaccuccgccucccggguucaagcaguucugccucagccucccgaguagcuaccaugcccggcuaauuuuuuuauuuuuaguagagacgagguuucaccauauuggcuaagcuggucuugaacuccuggccucagguaauccaccgcgcccagcugcuuuugcucucuuucaaguugauucaugcagaauaauagauguagcauuuauaagauucugguacaucuauuucuuauuucaacaaguugaguuauaguaauuuaguacaaaacaacgcaugcauuauaaauuuuuuuuuuuuuucuugagacugagccuugcucuguugcccaggcuggagugcaguggcacaaucucggcucacugcaagcucugccucccguguucacgccauucuccugccucagccucccuuguagcugggacuacaggcuccuaccaccacgcccagcuaauuuuguuuuuguauuuuuaguagagaugggguuucaccguguuagccaggauggucucgaucuccugaccucgugauccgccugccucggccucccaaagugcugggauuacaggcgugagccaccgugcccggccgcauuauaaauuuuuauaaguaauuauuauguaaaaaaguacaaguuuauuagaaaugcccucccuaaugagauagggcucccuuaccugccuugauuuauucaugucauuuauggaguuacuuguagccaaaguaagaguucucaguucaguucuuguuuuuguuuuuguaaauuuaagucccagaaauucuugcucacauaaauaaacuauaaaggaaaguaauaauggcugggcgcgguggcucacgccuguaaucccagcacuuugggaggcagaggcgggcggaucaccugaggucagcaguucaagaccagccuggccaacauggagaaaccccgucucuacuaaaaauauaaaaauuagccgggcguggucaggugcaguggcucacaccuguaaucccagcacuuugggaggccgaggcgggcagaucacgaggucaggagaucgagaccauccuggcuaacacagugaaaccccgucucuacuaaaaauacaaaaaauuagccaggcgugguggcgggcgucuguagucccagguacugaggaggcugaggcaggagaauggcgugaacccaggaggcggagcguggagugagccgagaucgugccacugcacuccagccugagcgacagagcgcaacuccgucucaaaaaaaaaaaaaaaaaaaaaaaaauuagccgggcgugguggcaugugccuguaaucccagcuacucgggaggcugaggcaggagaaucacuugaacuggggaggcggagguuucgaugagcugagauagcgccauuccauuccagccugggugacagagcaaaacucugccucaaaaaaaaaaaacaaaaccaaaaaaaauggcuuggcacgguggcucacaccuguaaucccagcacucugggaggccgaggcaggugcggaucaccugaggucaggaguucgagacuaaccuggcccacauggcgaaaccccgucucuacuaaaaaugcaaaaauuagccgggugugguggcuguugccuguaaucccagcaacuugggaggcugaggcaggagaaucgcuugaaccugggaggcagagauugcagugagcggagauugugccacugcacugcagccuggcggcagagcgagacuccgucucaaaaaaaaagggaauaaguuuaguuauagcaauguuuuguuuuuuuugagacaguuucgcucuuguugcccaggcuggagugcaguggcgugaucuuggcucaccgcaaccucugccucccaggguucaagugauucucccaccucagccucccgaguagcugggauuacaggcauacgccaccacacccggcuaauuuuguauuuuuaguagagacaggguuucuccacguuggucaggcuggucuugaacucccgaccucagguaauugguccaccucggccucccaaagugcugggauuacaggcgugagccaccacaccuagccagcaauguuacucaauauuuugaaaccugaauugugugccaaaaaaucacaguuacauauaaucaaaaauuaacuuaucaguugacaacuugguuagucuuuuaauuucauugaaaacuaagaauuagaaaccauccgacuugcaaaaggauuuaucuagucauuagucuucacucucagugagaaauauaacaaaaagccuuuagcaagucuuauaaauugguuauugauuaugccugcuauucuuucaguuaagagguaccuuguuucuuucuuucuuuguuauuucccagccgccuaccccugaaacagagucucaggcuggguuuauuuuuauuuuugguagagacgaagucuugcucugucucccaaccuggagugcaguggcuauucauaggugcuaucauggugcacuacagccuucaacuccugggcuuagcucccuaguagcugggauuacagaugugugccaaugcaccuggcuuucacacuuuuaauuaguguguuuuugcuguucuguauuagacuaugagcaacuuaagagcaagaccaagagucuggcauuguaccugcuguauuuggcagucaucaagcaucuguugacuguguguuaaugguauuauagaaggugcucugaagugagagucagaagcuguauggcuuugggcuaggaccaguugggaaguggaguugguagagguaaggcaggagguccugauuugcacauccauguuuagggcuucauugaucacacuaggagggagcgaccugaauguccaucacagaugaauggauaaagaaaauguggcauauccauacaacagaauauuauucagccuuaaaaaggaaggaaauaggcugggcacgguggcucaugccuguaaucccagcacuucgggaggccgaggcgggcggaucacgaggucaggagaucgagaccaucuuggcuaacacggugaaaccccgucucuacuaaaaauacaaaaaauuagccaggugagguggugggcaccuguagucccagcuacuugggaggcugaggcaggagaauggcgugaaccccgggaggcggagccugcagugagccgagauugucccacugcacuccagccugggcgacagcgagacuccaucucaaaaaaaaaaaaaaaaaaaaagaaggaaauacuguucugugcugcaacaugaucuuugaggacauuaugcuaagugaaauaagacagucacaaaaaauaaauauugcaugauucuacuuauuugagaugucuaaaauaaacucauagaaacagaaaguagaaugguaguugucaugggcucggggaagagauaggggaguuguucauggauauaacuagaugaguaaguucuacuuacacaacaaugugcauuugguuaacacuauugcauacuuuauuuacuaauuuuuuugacauggagccucacucugucgcccaggcuggagugcaguggugauaucuuggcucacugcagccucuaccuccuggauucaagcgauccuugugucucagccuccugaguagcugggacuacaggugccugccaccacgccuggcuaauuuuguauuuuuaguagagaugggauuuugccauguuggccaggcuggacucgaacuccugaccucaagugauccacccaccucagccucucaaagugcugggauuacagccaugagccacugcacccagccgacuacuguauacuuuaaaaaguuaagaugguaaauuuuauguucugugccuuugaccacaguuuuugaaaagugagacagaaacugugauuuuauaaaccacaugcccuaaaaauguucuaacaauauuauaagaguuguuuaauaaaggcauaucaauaaaauuuaaggaccaguguaagugguccgacauccgaauaauaggaauuacaggaagagagaaaacaaggugggaagugaccuauaaaauaguugauaacagaagcacaugagccaacagauuaaaacuguguacuugugccuagcacuagggaagaaaauagaccugcaccaggcauggaauuucugaacauugaguugauagaaaagauuuacaagcuucuggaugggaggguaccaggucacauaucaagaaucagaaugucuuuggacuucauggcagcagcauaggaagcaaaaagagaauuggaacaaugucuucaaaauucugaaggaaagugauuacuaaccuggacuucuguaccuagccuaacuauacaacaagaauaagugagaaaaagguguuuuuguuuuuuuuuuuuuuguuuuuuguuuguuuguuugagauggagucucacucugucgcccgggcuggaauucaguggcaugaucuuggcucacugcaaccuccaccuccuggguuugagcaauuccccugucuaggccuccugaguagcugggauuacaggcgccugccaccacaccuggcuaguuguuguuguuugagauggaguuuugcucuuguugcccaggcuggggugcaauggcgcgaucucugcucacugcaaccuccgccucuggguucaagcgauucuccugccucagccucccgaguagcugagauuacaggcaugcgccaccacgccuggauaauguuguguuuuuaguagagacaggauuucuccacguuggucaggcuggucuugaacucccaaccucaagugauccgcuugccucggccucccaaaguacugggauuacagacgugagccaccgcacccagcaaauuuuuguauuuuuaguacagaagggguuucaccauguuggccaggcuggucuugaacuccugaccucuagugauccacucaucucggcuucccaaaguggugggauuacaggccugagccacugugccuggccgaaaaagguuuaaaaaauuuaaaugucauacuccuucucaagaagcuacuggaagauguguuccaccaaauugaaagacuaaaucaugaaagaguaagacacagauacagcaaacaggagcccaacacaguagacauggccugggaggcccacagaggauggcgagaagugauccuaggguggcggcucugcaccagacguggagggcaacugagccauacugcagcagugcaacccaccgagaggugaaggcaggccauggugagcuuagaaacaggaaguacagggcagcccccuugcucugacuguauuuccacugcagguccagcgccugguccccaccuuggcccugccuggugccugacuaugcugagcccuguguuucccaaaacuccaagaucuugcucacgacuuccucaggaggggcuuugucagcucccggagaagcagaagucagaucacaaccuggagauugaugcgcucaccuccuggagccuccauccagcaggggcagugcugcccucuccuugcacugccagugugcaccugcucuccgcuuuaauauuaaucaucuuugauauucauuuacauguaguuauaauagcugcccaaauagugaaauaguaaauaaaauuaccaaaugaucuucuguggauguggccaugugcucuuaucuccugcggauucuugcuuagacuucacaugcuuacucugugagcccuuuccugagcaccuuauuuggaaucauaagucccaccaacucucucuuugagugauuuguuuucucgggaguacgucucagcuagaauauaggcucuaggagagccugugguuuuguuugcuuguuucucugcuguaucccuagggcccagagaguggcuggcucagucagcucucaauagauuuuuuuguuuuuguuuuaagacagggucucuugacucccaggcaggaguacaguggcccgaucuaggcucacugcaacuucugcuucccgggcucaagcuauucuccugcuucaguguccuuaguagcugggauuacagguaugagccaccauguccggcuaauuauuguauuuuuuguagagguggggucuugccguguuccccaggcuggucucgaacuccugagugcaaagcaauccgcuugccugggacucccaaagugcugggauuacaggccugacggcucucaguagauucuuauuggauaaauugaaugagaugaugaggaagaguuugcuagaaagagaaaggugggcaaggaugacgauucccagcaaggaggcagcuggcacagagccacagugccugcuguauggagcccuuugugcaguaaggagcugcugcugggcccaggcggcaggucccgggggcuucccuuaucuucagugcuguccugaaaacuuaguuguucaaggcuacuuuuuuuuaaaucagaaucucgcucugucaccaggcuggagugcaguggcacgaucuuggcucacugcaaccucugccuccuggguucaagcgauucuccugucucagccucccgaguagcugggacuacaggcgcacaccacgaugcguagcuaauuuuuuauuuuuaguagagacaggguuucaccauauuggucaggcuggucucaaacuccugaccucaggugauccacccgccucggccuccuaaagugcugggauuacaggcgugagccaccgugcccagcuggcuacuuucuauaguuauacuguccaugaggguagccaucagccaggucagguucuuaagcacguggaaugcaccuuguuaaacuugacuugugcuaaaaguguaaaaugcacacuggauuuugauaauuuaguaccacagauuuuuuuggugcacucacuucaguggcugucaccuguaaucccaacacuuugggaggccaaggcgggcggaucaugaggucaaguucgagaccacccuggccagcauggcgaaagcccgucucuacuaaaaauacaaaaauuagccgggcaugguggcgcacaccuguaaucccagcuacucgggaggcugaggcaggagaaucacuugaacccgggaggcagcgggugcagugagccaagaucaugccacugcacuccagccugggugacagagcgagacuccaucucaaaaaaagaaaaaaauaccgauuauggccaggcacaguagcucaugccuguaaucccagcacuuggggaggcugaacugggcagaucacuugagcccaggaguucaagaccagccugggcagcauggcaaaaccccaucuuuacaaaaaauuagccaggcuuggugguguacaccuguaguuccagcuacuagggaggcugaggugagaggaucaucugagccugggaggucagggcugcagugagcugugauugcaccacugcacuccaucgugggcaauagagugagaccuugucucaaagaaaaaaaaauacugauuacauguuaaaaagauaauauaggcccagugugguggcucacaccuguaaucccagcacuuugggaggccgagguggguggaucacgaggugaagagaucaagaccauccuggccaacauagcgaaacccccucucuacuaaaaauacagaaauuagcugggugugguggcgcacgccuguagucccagccacucaagaggcugaggcaggagaaucgcuugaacgcgggagguggagguugcagugagccgagaucgcaccacugcacuccagccuggcaacagagcuagacucugucuccaaaaaaaaaaaaaaaaaaaaaaaaaauauauauauauauaugguuaaauaacauuauuaaagauauuaagauuuuuucucaaaaaauacugauuauauguuaaaaaguucauauauauuggguuaaauaugauauuaaaauuggcaccaucuguuucuuuuuaugugcuacuagcaaauuuugcccacacuuguggcuggcauauuucuauuagugcuguugaguaaugaguacguuuguacuguguugaguuuaacacuuuauuagauacucuuuuuuuuuuuuuuuuuuuuuuuuuugagauggaaucucgcucugucgcccaggcuggagugcaguggcgugaucucagcucacuacaagcuccgccucccggguucacgccauucuccugccucagccucuggauauuacucuuuauguccucuuucaucuguggaacucauuuauuuuauuuuauuuuuuugagaaggagucucacucagcugcccaggcuggagugcaguggugcaaucucggcucaccgcaaccaccaucuuccagauucaagugauucuccagucucagccuccugaguagcugggauuacaggcacccgccaucaugcccagcuaauuuuuguauuuuaguagagacaggguuucaccauguuggccaggcuggucuugaacuccugaccucaggugauccgcccgucuuggccucccaaagugcugggauuacaggcgugaaccacagcaccuggcccaucuguggaacucuuaucucacugucacuucacaaucauuggaacaggaaagacuguauuuauaauuacugauuucaguuugcucaccuaaauccuagaugcuauuuuuuagugugugugugugugugugugugugugugugugugugugcgcgcgcgcgcgcgcgugcuggggugaaggaguccugaauucacauugucugucuuuggccucuggcaaucugccuucugauuucacuacucaauuaaaccagucuaucuugacaucuuuaaugcguuuuuacuuuuauuacccuccgugcuacguuugauaauauuucaaauuuuucuccuuaagauagaauugcugcacuuaacucccagauccauuuggacaaguagauucaauuguuuuauuuguaaagggaauaaggguguccagcuuggucaaaggaguuugaggaguacaugcauguucuggacuuacacaccgagugauugaugccucgaagaaagcgaauggcaaaggauuaagacaguaguggaugagaugaaucgggggggagaaguguuucuguuuggguuguuuuauuauuauuauuauuuuuuuuuuuuuuuuuuuuuuugaggcagaguuucgcccuuguugcccaggcugcagugcaauggugugcgauacuggcucacugcaaccuccgccucccgggcccggguucaagugauucuccugcuucagucucccaaguagcuagcugggacuacagguguacaccauggugccuggcuaauuuuuuauuuuuaguagagauggcguuucaccauguuggucaagcuggucucgaacucccgaccucaagugauccacccaccucggccucccaaagugcugggauuacaggcgugggccaccuugccuggccuuguuuggauuguuuuagaauguaaaauugggcugggcacaauggcucacgccuguaaucucagcacuuugggaggucaagguggguggaucccuugagcccagggguuugagagcagucuggguaauauggugaaaccccaucucuaaaaaaaugcaaaaauuagcugggugugguggcuccaucuguagucucagauacucaagaggcuacaaugggaggaucacuugagccugggagguggagacugcacuuagcugagauugcgccacugcacuccaaccuggguaacagagcgagacgcugucucaagaagaagaaauaaaugaauaugaaauugaaggcaggcauggugguucacgccugcaguccuagccuuuugguaggccaagucaggagggcugcuugaggccaggaguuccagaucagcuugggaaacauaaugagaccccauuuauuugaauaguaaaaaauuagcugaguaugguggcgcaugccuguagugcuagcuacuggggagacugaagugggaagauagagcucgggagguggaggcugcaguaagcuaggaucaccccacugcacuccagccugagugauagagcaagacccugucucaaaaagaaaaaaaaaaugugaaauugagcauauauuugaaagaagccacuaccacagugguucucaaacuuggccuuugucaaaaucaccugaagggcugacuaaaaccacuuucugugccccacgcuuagaguuucugacucagugaguaugggguagugccugggaauuugcauuuccaauagauucccaggugaugcugaugcuacuggccugggaucacacuuagagaaccacugcucuagaacaaaacaaauucaaguuauuuuugagaugaagaggggacgaauuugaaggacagaaagucucagaugaggcagguccagagggaauaagaaggugcagcugaagggaguuaaucuuugcaaggagaagugcuucccucuuacagaagagagaaagaaaagaguugauaagacgcuaaaagguuuugaggugaaagagaggcauauuuaagggagucaccuaaguuggacuuugagacacagcuuuaaaucaaauagaucuguguccaaauccugguucagcagucacacucacauuccaaguuguauaacuucuccaagccuuagugccuuuaucuugaaauucaggauaaccgaacagcacuuagccuguagguuguugugaagauugagugaugagcuaguacugcuuccuguuagugagcagagagagcgagccugggaaacaaaaagacaaagaacagagugaccuugacuguagcagugggggaggugggaaaguuaacugugaacuuucacuggauaccuguaauuugcugagcauuagacuuggcccuggggaugaaaagggcaaggcuuuggucuucagggauggaaggagaugcagagaaagugaacauguacaguacgacacaaaugcuuuaccacaaacaugaaacguaguauuguauacaaaguacuguuagagcauuagggauagaauaaggaauuugaccagcaguaggauaagugguuggagagaaaacacugcagaguugauguuugagcuaaaugaagcuuguccagccugcggccgagauggcuuugaaugcagcccaacacaaauucauaaacuuucuuaaaacacuaugagauuuaugcauggaccuuuuuuuuuuuuuaagcucaucagcuacuauuauuguuagcuuauuuuauuuguggcccaagacaguuuuuuuuuuuuuuaagacagagucucauucugucacccaugcuugaaugcaauggcgugaucucagcucacugcaaccucuaccucccagguugaagcaguuuuccuccuucagccucccgaguagcugagauuacaggagcccaccaccacgcccagcuaauuuuuuguauuuuuaguagagagaggguuucaccauguuggccaggcuggucucgaacuccugaccucgugauccaccugccucagcuucccaaagugcugggauuacaggugugagccaccaugccuggcaguuuuucuucuuucaguguggcccagggaagccaaaagauuggacaccccgagcuaaaucuuaaaacauuaguaggagguggccggucgcgguggcucaugccuguaaucccagcacuuuuggaggccgaggcagguggaucacgaggucaggagauggagaccauccuggcuaacacggugaaaccccaucucuacuaaaaauacaaaaaauuggccgggugugguggcgggcgccuguggucccagcugcucgggaggcugaggcgggggaguggcgucaaccugggaggccgagcuugcaguuagcugagaucaugccacugcacuccagccugggccugggcgacagacagagcgggacucugucucaaaaaaaaaaaaaaaaauuaggcggucaccagccuggaaguauauucucaguccugaaagacauucaguuuaaguuggggccccaagggaauggcagggaauucaacagagaaguuaauugggaaucagaucaaacaggccuuuaugugccagguuaaggaguuugaacuuuaucuguaaguaauggggaaauaagacacuuaaaauggugcagauauguguuuuauagcggucacacggauaacaucauaaaggguguguuagauccgagagagaauagaaacagaagucagcaugaaguuauuucugucaucuaggauaaaaaaugacuugaacuaacaugggcguaguauggagguaucucacuggagagagauuuagaagggcgaaucagaacucaaugccuggucaucggagaggacaaggauugacccaugcacugagacagggugcaugagagcaagguguggauuuggggaggaaggcaaagaacccagcucggacuggguuuacaguaaacccagcugggauuacaggcgugcgccaccacgccuggcuaauuuuuguauuuuuaguagagacaggguuuuuaccauauuggucuugaacuccugagcucaaggaaccacccacccgcagccucccaaagugcugggauuacaggcugagccacugugcccggcugugaguuuggaauaaugacuugcacucuauuuacuguuaauuuauauacagccuguacagagcagugucugcuguauaggaggacuuuggugaaugaguacucuaugagccccugagagcgucuccuuguucagaguaaaaguugguauuagaauuauagcaaugugggucaagugagguugcucacaccuguaaucccagcacuuugggaggccaaggcgggcagacugcuugaggucaggaguucaagaccagccugaccaacauggugaaaccccgucucuacuaaaaauacaaaaauuagccaggcaugguggcgggugccugucaucccagcuacucgggaggcugaggcaggagaaucacucgaaccugggaggcggagguugcagugagccggcauggugccacuggacuccagccugggugacagagugagacuccucucaaaaaaaaaaagaaguauagcaauguggaguuuuaaagccaauggaacucuagaucaucuaacccagccaucuucagguucuaaauggguuaugucuuaacgucacacauccaguuagcaaucgccugcauuguucucaugucuaccaagcaaccuucugagccucacugguuucccaaauugguuuuucucuagugaagagaauauacugacugccugccaagcacaagaaucaaucuauuuaacaauuuuguuucucagugaauucuaacuuugcuuauccugcaggaagagauuguauuguuaaauacuuacauagcuuugcuuuaaaaaaaucucuuuaaaaacuuuccaucgaaaaaggugaugguuauaugcacauagaacuauacacaugcauuauacugauaucagauuccuggguuugauauugugcuguaauuacguaaaacacagucauugggagaaacugggugaagggugcacaggaccucucuguacuaucuuugcaauuuccugugaauguauaauuauuucaaaaacguuuaaauuuaaaaagaugaugugaaaacguuuaggcaccaaacuacagaguuuucuggaaaauaccggaacuggaacuuaccuucucuauguccucgacaaguggauucagugacaggaauggagcuuauagggaucuuuaguucuuaucaugcugagugguuuguauucuaaaucagugacuauuccaaacuaguaagacaaauaaugucuuuaaaagugggaauuuuacuagcaggaauuuuagaacguuuagacaguucucugauuuuuuuuucuuuuucuuuucuuuuuuuuuuuuuuaauagggucuuucucuguccccuaggcuggagugcaguggcacgaucauggcucaccgcagucucccuccugggcucaaguguuccucucaccucaaccucccaaauagcugggacuacagauaugccccacugugccuggcuaauuauuuauuuuuuuuagaaauggcgucucacuguguugcccaggcuggucuugaacuccuggguucaagugauccuccugccuuauccucccaaagugcuaggauuacaggcgugagccaccacacccgaccauuuuuuuuucuuuuuuaaaaauauuuuacuggcccagcgcgguggcucacaccuauaaucccagcacuuugggagaccaaggugggcagaucacuugaggucaggaguucaagaccagccucgccaacauggugaaaccccgucucuacucaaaauacaaaaauuagccaggcaugguggcgcacgccugucaucccagcuacccgggaggcugaggcaggagaauagcuugaaccugcagagguugcagugagcugagaucgugccacugcacuccaacuggggcaacagagcaagacuccgacucaaaaaaaaaaaaauuacaaagauuguuuguggcgcugguaugugggauuuccucacagcacaguucauuuuucugguaaugacagcugcuggguaucugcgcuucacgaaggugcuccuauuuguacgguuugaaacugacucacucuguccugcugcugguguuugacaugcaagcuucucuuucggcaucacucucggaagugggaucaauucaccaagucuguucugacaaagggagucugucggcagcagaccccagcauucagaagggauccuucuugagacaucaaaccucaggaaaccuuguguaauuuucucaguuucaguggcaauaaaacaggaacaaugaugcucauccucuaggguuguuuugaagguugagugagauccugaauucacugggaauaauagguuaagaaugauuaacugggaauacaucauaaguaacuggaaaugaggggucagcaagcacaugacuuaagucaggacuucuuccuacagcacuugguucagauuugugcuuuaucaaauuaacaaguugcuacuugacauggauuucccuuccucaagucacugaaaacuugaguguuucaugaaauggaccuacuuuaccugaagagagggucagggcucccgaguguccuguggacauacagggacugggagagaaauguugaccaugggauuggguuggaauugccaauaguuaacaauuauugccuuaaaaacuucugauguuguaaguccuacccucacguggagucccagugagccacgcugguggagucccucugacucugaugaggaacacagguugggagggcaggaucucaacacaugguuaaaauaauucaagugagagauauguguguuaaugaauggagagaaguggguggguucaagaaauauuaaggagguagacucuacaggacuuggguaccaguuguauguagggacuaaggaggagcgggagggaggcugguuucugguuuaugugacagggcggcugguagugacagucuuaugugggaacagaggaaaggaaacaggacuggggagaggcuggccucagcuuuggacagaugucaucugagucaucacucaaguggacaggggcucaguaggucuucggauagacagaaguaagagcucugcagagguggggcaucagauggcacauuuauucacagacacuuaucaagugcugggcacugucgaaggcacuggggucucugcuuggcauucuagugucggguuaggcccugacacuagaugagugccucuggugaggggaucagcaagaaaguacuauggugugggugguaggugauguggaugauggaggagauaagccaccugaauuagaagcugagucauccccagaaaaguuagagggaagaggugcucugggcaaagagaagagcaggugcagaggccccaggcagcacugagcaggcacauuugagaagcuauaagcuguaagccagccgcaugaccccagcaugcugcacagcagggagggcuaugagggaaguuggaagggacaagggcugaguggaucagcguuugguucccagacaguuggguuuauuugagugugauguucagucaugggaauuugaaggcaugggaaugugugaaaucucucagguagacuauguagaguaaaagggggagaggacuguacuauuugauagaagggcaggagaaggggagacuucucaaaggauacuagaaacaaccaaccauaaaagcagaagaggauacaagaaaagugguaaagaaaaagggaacuuuaaagauggaagcaggccgggcgcaguggcucaugccuguaaucccagcacuuugggaggccgaggugggcagaucacaaggucaggagaucgagaccauccuggcuaacacagugaaaccccgucucuacuaaaaauacaaaaacaaaguuagccgggcgugguggcaggcgccuguaguccagcuacuugggaggcugaggcaggagaauggcaugaacccgggagguggagcuugcagugagccgagaucgcgccacugcacuccagccugggugacagagcgagucuccgucucaaaaaaaagauggaaggaggccaggugcaauggcucacaccuguaaucccagcacuuuaggaggcugaggcaggagggucgcuucggcccaggaguuugagacuagccuggacaacauagugagacuccugucuccacaaaagcaaaaaaauuagccaguuauggugguucaugccuguggucccagcuacucaggaggcugaggcgggaggaucacuugagcccaggaguuugaggcugccaugagccuugaucaucacccauuguacuccagcaugggugacagagugagacccugucucuuaaaaaaaauuaauaaagggcugggugaggugccucacaccuguaaucccagcacuuugggaggccgaggugagcggaucaccugaggucaggaguuugagaccagcuggccaacauggcgaaaccccaucucuacuaaaaauacaaaauuagcuggacaugguggugcacgccuguaauccccgcugcucgagagacugaggcaggagagucacuugaaccugggaggcagagguugcagugagccgagauugcaccauugcacuccagccugggcaacaagagugaaacuccgucucaauaauaauaauaaagaugaauuauuaaguggcagaugauaagagggagaggaagggagugcagggagagagggaaaggaaggacugaaaauauggccuauguguaacaguaggaagaucauugcuggccuuggagaaagcaguucucaacuccucccuuccuuuuccccacaucccauugauuuccagauuggccaggaauguaauccauauugccauagaucaaggugcuggcucuaaggggugggaacugguggaguuuggcugacaggaagaugauagaagagguaaaaaagaggaggcaggaggaaaagcaaauuuccugaugaguagggcuagaaaggggcauuggcugccaguguguaaggagcacucaugaaagaaccacgcgugucuucagcagcugugucugucagcucagaguggaagcauguagguauugucauuuuuuggugaguuuggccacaaagcauucugggagugcagcggugggugguugaagaaggaggaaguggagauaggcaaaggauuauccuuccuauaaggcuagugcauggugggugagagacugacaggaugcugcuuaggaguccaaaagguguggccagcuccagcuugauucagagcaguggugguauccuggagcuccucucccagagcagaggauggcagguggcgccuggagaguguggccucccagcgagggagcuggcacaggcuaggaugggacuuaggucagcggggugucuugguggaaggcugagcacacgugguucuccagccgaccacgagcaucugaucauauuaucucccaggacuggguccuccuggaacccuguacacugcagaaacucuucaguaguuacaacaggaaccuuugagcugagcacccagaaguaccagaugugcuggagcaggcuccuguauuuauacguggcagccagucuaguauugcuuuauagcaccuucugugucuguucuuacauaacuuuuaaucuguucaggcuguuugcccaucucuauugugauucuuugaguucaggcuccaaggcucacucauccuugcccugcauaucagacacuccugcaaaugcucagggcuuaaaaaucugccggggccaccacauuacacacuccuauccccgucuacguuauuccaguuaaauuuugugaguaguugacaaaaugcccuacuguuuccuuugguuaaaagcaauagguauuacaaaauucaguuguuacauuggaacuugucugcagcuguuugcaugugaauauugaaugagggagugguagcuuuuguaauuguuagggcaaagaaagauucuguuucuaaucugagacaaccagcugacucaucaagugccuugacccuuuagauuuccaucuuucuuuuuccccuaggaagauggaaaacugagcucccagguuuacagauagcccagaccuggcacuguggaacaaaagaaaaugguagaaaagaugaaaaucaaggaaauguuagcaacuaauuuuuauuuccucugaccauuuaaauggguaugaauuuaccuuccacaaggaaaacuuuucaaauaauggcuuuuuauaaagggucuauuuuaugugcgugguucccuuccaccccuagguggcaggagaaagcagaagaaccugcaugaaaguaaagcaaacguccugcagcuguggggcgguguucugaauccuaggauuguugcuuaccucugcccugcaguuccauuugucaggcauuccugcgauuuuuuuuuuuuuucagaccgacuuaguuacccauauauggauuuuuaaaaauacugacuuggcuaggauuuauagagcacuguguagucagcuuuaacaguuaagaaauaagcaaaucuugauguggggaaaagaagaacaggaacauuagaauuggggauuagagguugagaaaaugguccucccugguguccaguggguaaucugcuguugagaacugaugcccguggaguugccccaggcaggacgcccaggccagggcacuucaccugggccccugggguugguguggagagucagguggccuuucucugcagccggagaagcuagcacagggggcuccccgucuccucugaauccugucuaaagauaauaaugagggcuguuacuuggaacauuuucuaauaacaugcuauagaugcuuaggguuuaugggaaggggggaugguacugggggugggggauaaaggacaaaaacguaauaaaguaaacacaggaaaggagcagcauguguuuggaagcugagcauaggcacucccucugagcaguggaguugaguccugacugcagcacaugcaggugaggaagcaguagaaggaguccgucuucuguccccuucccaucccuucugacauguucuuaucuugaaaucgccgccccugaacucccaggguacuuacugugugcugcucucacucuguagcccugucuguguaugucccauguccugaaagcccacccgaggaggagcugucuucuuugucuuuauguuccccacagcacuugucucuggcacaaggcagaaucuuaauaacuucaguggcaugaauccaucgaggagcagaugggaagcagagucacagugucacaccagacagauuauguucaagcaaauagucccaauaagaaguagugaggggccggccgggcgcaguggcucacaccuguaaucccagcccuuugggagacugaggugggcaaaucaccugaggucuggaguucaagaccagucugaccaacauggagaaaccccgucucuacuaaaaauacaaaauuagcugggcaugguggcacaugccuguaaucccagcuacucuggaggcugaggcaggagaauggcuugaacccuggaggcggagguugcugugagccaagaucacgccauugcacuccagccugggcaacaagagcgaaacucugucucaaaaaaaaaaaaagugaggggcugggcacaguggcucaugccuguaaucccagcacuuugggaggcugagacgggugaaucacuugaggccaggaguuugugaccagccuggccaacauggugaaaccccgucccuaccaaaaaauaccggaaguuagccaggcacaguggugcacaucuguaaucccagcuacuugggagguugaggcaugagaauugauugaacucaggagacggagguugcaguuagcugagauugugccaccgcacuccacccagccuggcggcagagcaaggcuccaucucaaaacauauauauauauauaauauauauauguguguguguguguguguguguguacucucuggcauuuuuuuguuggcuccauucuugggcauaccgccagacgagauggcugugggcagccucaugccugucuccugcagaaagaggacugcagaagcacuuuagcuagacaucaguucugacuggccagguauaggaccgucagggaaaauggagguguguccccagaaaugggaguguacacuaugcaagcagaacccacuggcgagcauugcagggacaucagcccuuggcuuguuacugucauagcagagcaaauucauauguaucuuaagucauucuuuucaauguuuuucagcaucuucaugauacaguuaagaggaaucuugacagcgccacuuccccucagaauggcgaucaacagaauggcuacggggaccucuuuccugggcauaagaagacucgccgggaggccccucugggaguugccaucucuuccaauggacugccuccagccuccccccucggucagucugacaagccuucuggagccgacgcccugcaguccagugggaagcacucucuggggcuagacucucucaacaaaaagcgucuggcugacuccagccuucacuugaauggaggcaguaaccccagugagucauuuccucugagccugaauaaagaacugaagcaggagccugucgaagaccugccuugcaugaucacugggacugucggcuccauaucgcaaagcaaccucaugccagaccucaaccuuaacgagcaggaguggaaggagcucaucgaggagcugaacaggucggugcccgaugaagacaugaaggaccuguuuaaugaggacuucgaggagaagaaggacccagagucuucuggcucugccacacaaacccccuuggcacaggacauuaauauuaagacggaauucucuccagcagccuuugagcaagaacaguuaggcucuccacaagugagggccgggucugcagggcagaccuuucuggggccuuccucugccccugugaguacagauucccccagccuagggggcucccaaaccuuauuccacaccucuggucagccccgggcggacaaucccaguccaaaccugaugccggcaucagcccaggcccagaacgcacaaagagcccuugcaggugugguauugcccagucagggcccaggaggggccucagagcuguccucugcccaccagcuccagcagaucgcugccaagcagaagcgcgagcagaugcuccagaacccacagcaggccaccccggcaccagccccgggccagauguccacauggcagcagacggggcccucccacaguuccuuagaugucccuuaccccauggagaagccugccagcccuuccagcuacaagcaagacuucacuaacuccaaacugcucaugaugccuagugugaauaagaguuccccucggcccggaggccccuaccuccagcccagccaugugaaccugcugagucaccagccaccgaguaacuugaaucagaacuccgcgaauaaccaggggucugugcuggacuacggcaauacaaaaccccuuucucauuacaaagcggacugugggcaaggcagcccggggucuggccagagcaagccagcccugauggcuuaucuuccccagcagcugucccauauaagucacgagcagaacucccuguuucugaugaagccaaagccaggaaauaugccuuuccgaucacugguuccaccuggccagguaaguaugagccuuugcuuucuguuccucugcugcagacacuucagugagguuacucacuacuuuggauguuaauuggauccgagguaguugugggaagagggaggagggaauagcugcugucauccuugcuccucuugggaguggaaauuuauaaaauaaaccaggguugauuguuaauaaaaaauaggguaaaguucccuggcauagcuugauuauuaacugcacgaagguuucaggaaucaccugcauuuaguccacugucucuuucgugccguaggauuuaaauuaaguaauuugcgacuguguuuugcagauaaacauuacguuucacgugcuucuuagaggcuuggcuuuuuuuuuuuuuuuuuuuuuuuacuaccuuucagaucuccauguacaaaauucccuaauuuuugguaagcuuauaacauuguaggcaugugcugcuucccagcacagcucagcucugugcuuacuucaucaugguucuaaagcccgguagcaucaaauggaaaauggcccuucggguuguuuccuguuuuccgcuagugcagauaagccugcagugaacgugaauuuguaauacaugcuaaaauuuugcaaauuaaaaagcccagugccgguaauaucaugaggaaauagacacacuccuguauugaugagaguguguaaaugagcucacugcuuuugggaagucauuugacauuauguauuuuucacaugcuguaaaauguucauaugcauugacacacuauauacccgacaaguugaucuaaagaaauaauccaaaauaaaagaaaaaguuauauccaagauauucauugugugguuauuucuaauagccaaaaacuguaagccauuuaagcaucucccagugcugauaauuccacuuacuucagccaguaagaugucucacgccguucagcacccccugaagagaggcucagcugcacacagugagggugcuugccaucuggguagcacuuugcaacuuacgaagcacucucaguaguucuuaagcuucuggugauuagagugaagaaauuauaccagaaucuuagaaugaauaacuagaaaggagcucaacaauuugaacugguuuaaauaaugauugcuuuuugccuaucuucugcuaaguuccccuuuucuucuaagugucaguaaugacgggauaauauugugguggccuuugacaugacucucacuuguggucuauauauugacagagaauaucuguuaaaguucucauugauucucaguauuuuuugaggauggguauuugacaaaagcuaagcagucucuuccaguaaaaugcuugcgcagauguacaguuucgggucguucagggauagcccgaaauccaagguuuaugcacaugggacagaguggucuccauugaccaaagcccccuucaaaguguucuuccccuaggccgggugcaguggcucaugccuguaaucccagcacuuugagaggccgagguggguggagcaccugaggucgggaguucgagaccagcgugaccaacauggagaaacccccaucucuacuaaaaauacaaaauuagccaggugugguggcacaugccucuaaucccagcuacucaggaggcugaggcaggggaaucgcuugaauucgggaggcagagguugcggugagccaagaucgugccauugcacuccagccugggcaacaagagcgaaacuccgucugaaaaaaaacaaaaaguauucuuccccuauuggcccgcucugcacucagauguccugauaagugagcauuucuaagccucgauugcuuacuggaacuauugugugcaaauaugaaagcuuacauaugcuuaacguaaaaccauaccuuugucacuggugaaucacugggaguaaaacuaacaccuauggaguaauuguucguugcuaggcgccuguaugcucagaugucaucacuuuuggucugugcuccagcccugugggaugguuguuauucgaggucagaagggaagcagagacuuggcuucaagagagugaaccuugaauucacuggauggagcuuauuuggucugaucagagcuuagagacuucacaguccccuaucuguguugacaggagcagaacccuuccagugucccugugcaagcccaggcuaccaguguugggacccagccgccugccguguccguggccagcucccacaacagcucccccuaucucagcagccagcaacaggccgcuguaaugaagcagcaucaguugcuuuuggaccaacagaaacaaagggagcagcagcaaaagcauuuacagcaacagcaguuccuucagaggcaacagcaccuucucgcggaacagguaaaaagaaaaguggaaggaaaccaccgcuucccaccuuugccugcacccugcgucacugcuacagucacaccuucugcuugugcguguggauuugcgcagacuugcgugccuguuguuagagugcuuugccuuuuaaaaacaucuuuccaggaauguggcauuucucagacagggguagucuugucagaagcugcuucgugucacuuaguggagaguacucaaggcagacucgggggcuaaaacuguuuguggaagggacauuuuccuauguuucaggucagcagcuuccaagccacugagcucacgugucugucauuccacuauggagucagcuuugcugccacuacagagccuguuauaagccagaacgugaagagggaagugaagucaucccugagggaaacacaguucacucgcuugguuagcaaguguagugugcaggcacuaaggguuacaagugagaguucuuuuuuuuuuuuggagacagagucuugcugucacccaggcuggacugcaguggugcgaucuuggcucacugcagccuccaccucauggguucaugcaauucuccugccucagccucccgaguagcugggacuacaggcaagaaccaccaugccuggcuaauuuuuguguuuuuaguagagaugggguuucaccacguuggccaggcuggucuugagcuccugaccucaagugauccacucaucucggccucccaaagugcugagauuacaggcgugagccaccacgccuggccuuaaauuacaucuuuaagacauaagaacuggcuccagacagugagguucauugaggacaaucccugccucaguucugccuuuaagaaaagcagcuuuauugugauguaacucacacagcauacacuucacccacguaagugaacaauuuagucauuuuuaguauaucacagaguugugcaaccauuaccacaauccauuuuagaacauuuucauuacccuaaaacaaaucccauacccaugagcagccauucucccauccacccugccucuccagcuccugaucuacuuucugucucuauaauugucugcucugggcugggcgcaguggcucacuccuauaaucccagcacuuugggaggccgaggugggcggaucacgaggucaggagaucaagaccauccuggcuaacacagugaaaccccgucucuacuaaaaauacaaaaaauuagccaaguguggugacgggcgccuguagucccagcuacucgggaggccgaggcaggagaauggcgugaaccugggaggggagcuugcagugagcagagaucgcgccacugcacuccagccugggcgacagagcaagacuccaucucaaaaaaaaaaaauugucuguucuggacauuuuauauuuauguuaugucauuuucaaucaugugcuagguaacagcaauugauuccucuugauaauaauauuccauuguauggacauguuacauuuuauucauucgucuguucaugaacauuuggguuucuuguuugggcuguuaaugaguauugcugcuaugaacauucauguacaaguuuucauauagacaucuguuuucauuuuucuuggguagauaccugggaguggaauugcuggaucacaugguaauuuuuauguuuaaccuuuggaggaacugucagacuguuucccacaggcugucucauuuuacauucccaccagcgguguaugagggugcugauuucucuacauccucaccaaccacuuguuaucaucugacuuugauucuggccauccuagugggaucucauuguagcugugauuugcauuuuccuaaccagcucuccauuuuuuaaaaacagguauaccuaccuuuuaaaaaagucauugcucccuagaucuguuucauacuauuuaaaaaccccaaaaugaaaucagcacuauuuccacaggagcccauuugugaguaacaaacuuggauaaguuacuuuucucugaccucccucacucccuuuguuuuggauuuuguuauauguugguuuuguuuuguuguucuuggcauuuucuaggagaagcaacaguuucagcgccaucugacccgcccaccaccccaguaccaagacccgacacaaggcagcuucccacagcagguuggacaguucacagguagggggugucugugugacgagcagggacaggggaggccgcugccuggugcugguugaaucccugcugucugcccagcucuaugccuugacuucaucaggcugcaugcauugucaucauauacaccucaguuugccuaaggggccugguuuucuaguuacuccacggcaucaggagaagagggcacagaggcaaaccacuagaacuaccuuugcugggucccuggcuguacaguuuucugaagcaaaaucauuucuaguuggaggacaucuuaucagcaggaaauagcuucuguaauucucaagaaaguucuuugcuucugcuuuuaugugucuucaaaaaaugacuccuaucuuccagauaaggacuuaaugcacuugcguggccuuuggcuucuuucucuccuccugucugcucacuugaauaucacagauggcagcaucacuaguggacaguuggccagaaaagggcaggaagcacacuugagucuagcugucgccucugagaugugccagggaacuucauaggccaucccuccagaaaugcacaaagauuucagggaauggauacaggaagcucuggucugcccgccuuccuagcuccucucagaaugucuuagaaaccucuguuuuuccuuauuugggaccuugcuauaaagggucccagagagacugaccacagcuguguguccuggaggagaccagguacgguuuuauguaugugcuaccuggggucaacgugggguugaaaucugcaggcauuucagaagcaugggucugacccauguuuucugccuucagacccaucugacauuuuguggauuauugaugggaaugaaauagccgguuucagcucuccucuuuuccucaacccaauuucauuguuguuguuuugaaacagagucuuggucugucgcccaggcugcagugcaguggcacgaucuuggcucacuacaaccuccaccuccuagguucaagcgauucuccugccucagccucccaagcagcugggauuacaggcgccugccaccacgcccggcucauuuuuguauuuuuaguagagaugggcuuucaccauguuagccaggcugaucucacauaccugaccucgugaucugcccgccuuggccucccaaagugcuaggauuacaggugugagcuaccgugcccggccccaauuuuuauuauaugguugcuaguagagaggaagaagaacaaagcacugaguuacggccaaucccugaacaaugacucuccuacccacaaaaccuaauucaguuaaugguguugucauauguccauugcuuaagccaggaggccuagacagcaguucccugagcauaggggugcuuucucuuccacccucugcugucucuccagcacagcaccugccacagaguggguacucagugaagaucugguaauuuccugcgacuccucccuccuuuggccaccuugucauuucauaguauaaauggugugccauaagaugguauauugucuggugagauguugucacacaguucugcaccuccaccccccauucccacauggucugcccucccucaucuccgugacugaacagccucuccccagcauggucucagccacacucucaguccagccacucuugggcuuuacaacccuguucuuuguuuguuuguuugagacagagucuugcucuuucgccuaggcuggagugcaguggcaugaucucggcucacugcagccuccgccucccggauucaagcaauucuccugccucagccucccgaguagcugggggcgcgcgccgccacgccuggcuaauuuuuguauuuuuaguagagacaggguuucacuauguuggccaggauggucuugaucuccugaccucgugauucgcccgccucggucucccaaagugcugggauuacaggcgugaaccaccgcgcccggccacaaccccguucuucacacgccauccacagcucuucccuaucuggccggaacuagcucuuccauuuuaucucuaaccagcuggccacugucugcauaucccggccacggccagucucugaaaguuccccacacagaugccuuuuucugacucugccuuugcacacacuugccuggaaugcucuuuuuccccaaacuguuaaauugcuaaacuucugugcuuuuaaaccuaguggauucaucacugucucucucaagccuugcccaaggcuucccagaugccagggcuuccagccugcacccugcagccugcuggccaggcgcgccccaucgcgccccauugcgccccaucgugccaugugcuaacuuugccucccagaggcggaucuugcguuggguccaccucagaguccccggugcccaccacaggguccccacagagcagaaauuuggugggugcuugaaaguuagaugaaguaggucacugguuuucucuccccuggggcuuugcccuuccucugugccuuucugaaccccaucauuguuucagagaccaggccuccauuccaccuguggaaggcuuucugccccauggcccccggggcccucuucccagugugccgugaacgugagacuucuggugcugcggcucgagucucagagggacccagugguggucgacuccugacugccagacucuucucugucuuguaggguccucugcugccgugcccggcaugaacaccuuggguccauccaacuccagcuguccucgaguguucccucaggcugggaaucugaugccaaugggcccuggacaugcuucaguuuccucucuccccacaaacucaggccaacaggaccgggguguggcucaguucccuggcucccaaaacaugccucagagcagccucuauggcauggcuucuggcauaacccagauaguugcccagcccccgccacaggccaccaauggacaugcccacauuccacggcagaccaacgugggccagaacaccuccgucucagcugccuaugggcagaacucucugggaagcucuggccucucccagcagcacaauaaggggacccugaacccugguuuaacaaagccaccggucccaagggugucaccagccaugggaggccagaauuccuccuggcagcaucagggaaugccgaaccucaguggccagaccccagggaacagcaacgugagucccuucacugcagccuccaguuuccacaugcagcagcaggcccaccugaaaaugucuagcccgcaauucucccaggcagugcccaacaggcccauggcucccaugagcucagcagcugccgugggguccuugcuacccccagugagugcacagcagaggaccagcgccccugccccagcaccacccccaacagccccucagcagggcuugccuggccugagcccagcagggccugagcugggggccuucagccagagcccugccucacagaugggcggucgggcggggcugcacugcacccaggccuacccugugcggaccgcgggccaggagcugccuuuugccuauagcgggcagccagguggcagugggcucucuaguguggcuggacacaccgaucugaucgacucccugcugaagaacaggacuucagaggaguggaugagugauuuggacgaccuguuagggucucaguaauggaaggauuuguaguguuuuuaguguucauucauccuauauuuuuauucucagauucaaagaaagagcaacuacuuuggaccaaaagcccauggccuggggagcugggcagguagagcccaagcuccaggugaggccuggcccugggcagggucuguggcugcgccccucaggccagcaguugagguccaucgggcuggccccagcccaucugcuggcaucaguaccugguguugggacagcaggauaggguucuaaaggugguuuucuauccaaacgaccaaaaaaccaacaguaacaccagugaaaccccacacugucgggcuuauaaaaaucugugccaucauggugauuuuauccaagacugcuccacuuaccccagugcuggggacaaguuucuguugaaacuuuagauagcagaauuauuugcaauuuguagcauagaaaagauuuuuaaauuuuuuuacaaaagguuuuuaaacagauuaggguaggugaugguuuaaaucaauuaaguggcauuggaaaccuaggguuuccuuuugauuaagagccuuuuuuguuucugcucuuugucagcuuucaggggagaaggaggccacuggaaaauuauuucccuaagugcaggcuguugacugcguaugccaaaaagggacaggaggcaugggauagcaggucuggugacacagcuagggucuuccuagcagcuccuccuccucccucccaaggcccccaggaaucccuuccucccauguccuggcagcaggaccccaggcuacauauggaagguagagauguggggguccuguauccuggaguauuaugucuccccaccuucugcaguuuucucugaacauguauguugcccauggugggagcguggucacugugcaguugugcacagaugucuuuccuuuaccguuggccuuucugucugccucuccuuccucucugcagcccaaauggaaaacaauuauuuacuccauuggagggaaaggaagagucuuagaauuccuaagggaaccuuagcauaaagguuuuggggaaggaggccguaggccggcccggaggaagcaauuccacuugguuugacaacuucugccacucccaugucagaugacuugcacuucuuaaagagauugcuuuauaacacuaagacauccuuucuaaagauucaaguggacuugacuaagcugaggguccacgaaauagaauaugacaugugagcuguuuuuggaaaacgaagauggagagagcacuuccccguaacgaaagcaaagugguaagcacagggugagacccuuuuacacagaaugguggagagaaaagagaaugcugaaaaguggcucagaugcagaguguucuguggagaaacugcagccccacuucuguuucccuggagucucccaauggaucauucaggaguguccuaugugagaauugagccaaggaaaauacucaugcaaccagccugagucgcggugaggggacgagagguuguacacacauugguaguuauuuugcaccagcagugccuuucucacuggggguacuuggacccucagaucuucuuuucuaauagccauuugccaccccaagugguaugucggccauuucuccuuaaaacaccuucccuaccuuucccauguacucaguuuagcucucaaagaaggggugaaucauaaagccagugaaaauuucacccucugagggaguuccccaaucugaaggggaagagggugaccucagcggcuuuucucccaaaaaucggcugaaggcugguuguggauccuuguuccucuccugaccccaucuggcugcugccccgucucccaccccuguccccggggcucgcuggcccugcacuccgccuuaguccuggggccggcgacacagugggggcuccucacuugcugcagugucauagcaauaaaaugugauucuugggguccccccagggagcugcccauggcuuuauuuaugaaccugguuuucgggagucaggggaggagaugacuuugcuucugugcacagccccgucuuccaggagccacaacucagaagaaaagggugcucagacuuuuguuauacacauuugcuuuguguaaauaaauguuuacaauuuuauaugaaagauggaauaagcgcuagagcuuccaacuguauauuuuuuacuuuuauagauuuuaaaacuaugauccuuuauauguguguuuugggggagcuaugauaaguuuuauggcaaacgguugguauuguuaacuuuuuauugucaucaaaaguucauaaaaguccuauuaauccccauauucuucuacugcccuuaacucugguauacaccaaaaagaaaucuuuacuuuccuuguuuuaucauuauaaaaauaaaguauuuugcuaguauggaaacaa

SEQ ID NO: 193030 - RNA, 16553 nt, Homo sapiens
ugaaauaguuaagagauuuuauucuaauagcuauaauuacagugcuuguuugucgaaaugaaaacugaaaacaaguauacaaaacaguugauuacuaaucguguauugaaagcaguaagagguuccacgacaccaaauagaccaguucugagguuuccccaagauaaauuuaacagcuccagcuucaguguuuaucaaaauacaaaagaaaaaaguagagguugucuuuuucgauggcaaaucggacccuugcaggcugagggagagaaagcuacaucacacacagagguggggugcucccgaggggcugugggucuagguggaccgccugcccggcuugcacgcgcuccugcuggugaggccccagacauccugccaaagugucugagcgagcacgaguguuggggacgacggacccacucuggccacacggcgaccgagggacagauggggcccugcgucccauaggcugccugaagguggguagggcggccugcggcauagugggguggcugugggcucccagccuggccccugggaaccgugggagcacagggacaagcacauggcuauggaaugcagggugacccaaggacaagcgaguugcggggaucucuacugugaccaugcagaauugaucgcagucugcugcgccaccaccaccucauguucccgaggggaacagcugggcuggcgacuggcauccaggccguaacugcaaaucuaugcuaggcggggucucccuucuguguguucaaguguucucgacuuggauucuuaacuauuuuaaaaaaugcacugaguuuggguuaaaaaccaaccaccaaaauggauuucaacacagcucuaaagccaagggcguggccggcucucccaacacagcgacuccuggaggccaggugcccaugggccuacauccccucucagcacugaacagugaguugauuuuucuuuuuacaauaaaaaaagcugaguaauauugcauaggaguaccagaaacugccucauuggaaacaaaaacuauuuacauuaaauaaaaagccuggccgcaggcugcgucugccacauuuacagcacggugcgaugcacacggugaccaaaccacggaggcagcuucuggcacucacaccacgagccgcacguuugccacaugagaguaaagcagagggcaagaggagugagagggaggggggucgcguucacuucugguuccggagcugauuggacagccaguccaguccuucauagagcccgucgccgcugguggcgcagguggccugaauguaccaguuccuguggcguagugagugcagccccagcuugucugugaucucggccgcauucauggcguuggggagguccugggggaaggaaggguuggugggaagggcuguccacaggacagagaaaggggccccaccagccuccaguaaccccuaccaccaggcggaacccacacuggcuccucacauuccccaggcuggcccgggcgccuaccugcuuguuggcgaacaccaggaggacagcaucccggagcucguccucggccagcauccucaugagcuccucacgggccucguucacacgcucucugucauugcuguccaccacgaagaucaggccugccgggcagccagugucaaauggucaugggaacacagccccccugccgcaucuaugggcaucgaugccccaucuaugggcuggcccccccucucuagaagcaggagugcccaugggaccaggccccagccacuuaccuuguguguucuggaaguaguggcgccacaggggccggaucuuguccuggccacccacgucccacacagugaagcugauguucuuguacuccacgguuuccacguugaagccugggugcgggaugcagggugaggccuuguaccuuggcccagcccagcccagcccacucccugcuggcccccaccucaccuauggugggaaugguggucacgaucucacccagcuuaagcuuguagaggaucguggucuucccugcagcauccaggcccaccaugaggaugcgcauuucuuuuuugccaaaaaggcccuugaagagguuggcgaagauguuccccaugcuuguggacagguggaaggacacuggccagggacaccuggagagacaaggugcuccaugucugguucugugcugcccagcagugguugcucagaacccacccacccagggaugcaccacugccucaccccaccuccuggaagccugcagggaaacagggaaagagcccugccucccaugccccccaaauccaccucaggaugggggcugagggaaaauggcugagucaggaauugagaaacuguugcccucaucuugggaagcuguccccacagcugcauggccagaaaggcugccucaucccagccuaugcaggaggggaggcuggcugccugaggacuggcuuccaggugcgugcaaggcuccucuacaccccaacacagaaccuuccagggccagagagcaccacucacugugccugcccacacucacaaggaccagagcacacagggccacgccagacucagcaggacaccuucagggacacacucccaugaggacacagccucgauggggcacgcccgccaugucugccccacaccgcaaggguagggguucccucagcagaacacaaauaucggggacagcaauuaagucagcuggcacccaccaucagagcccugcggagacuccagcaggaagggccuccacugcccagacgccucugugaggacacugaaguuguuaggcuuuggccucacuggccagugggcaauuucacgaaucaggugauuuuaucccgaacagggacuuuagaaaacacuggucacuuucugaaacaaugacugcuucuucacugcacccgcaagcggggcuuaccccgagugaggaaggcuucugccuucaagaggacaugccaggagccugugagcacacccaccccucaucagaccuccuccaccagggguuccacacacagguggcuuuuggcugaaucacagccaugacuguccgcuggugacucucucauccagucaccccagcacgcuacggcaaggaaaugccucuucuccauuucucaacaucagcaagagcccacacaugccuguguguuucagugggugugaacuggccgcccgugucugauuuaacacugccaucaucccagaugagccacagaaccccuucaagcuggaucaguguccuuuggacacuuugcucuugguuuugaacaugucaccuauucugaaauuuaaaugaguucugaaauuuauaaggaccuucacuguaguguucccuuuuuggggacggccagguuuucuaagcccagaggaagaccaccacccauggagcacagaagagacugaauaccugcccucucaguccacuccugcaaccacuaccaaugaagacaccaaaaugacacacacgccuugaagggcagagagaaaagggaggaagaccuuggaugugaugauugaccaggcagagaaaacuggaccgccugggacccaagggaugaagcugggacugccuagggcagcaauguccaaucuuggcuacccugggccacaauggaagaagaauugucuuggaccacacacaaaauauacuaacacaacagcuggugaaccaaaccaaaacaaaaacccccaaaaucucaauguuuuauuagaaauuuguguugggucggguucaaagccauccugggccacaugcggccuaaggguuggacaagcuuggucuaggggagcagcugcagcagggcuuaggccugcgcugagccaugacaacacacuugagccaugaaauuccagaauaauuccugagaguucuauaugccccagcagauccacacacaagcaacuggagcuccgcccacccccaccccccaccaagagacaggccugucugccuuugaaaggccaccaacauaagagacccaaauauaaaaggaaucugcaaggaggcaaccaagacaggagacugaagacagaauacuauuuuaacaaaggacaaggagagaaaccugauagauacacaaauagcugaaaaggaaaauucaaaaugaaggugcucagaaggcagaacaaaaacaaacagaaugaaaaaggaagaugaggaguaacuuaagauaucaaccaacagaaacccuaaaaagaaagaacguacgaaauuacggggugaaauuuuucccuguuccagaguggggacccaggaaucugggcuucggccucaaagggcugaagcgcaaagccaaggaccuagaugagacccaauaaaggugcaagguggacuccagaaugcacaggggcaaaugacaccucugaugccccagagaauggaagacucugaaacacugcuuucgaaacccuuuaauucuauacccagccaaaguauccaacaaguguuaggggagaaugaaaauaacucccaaacugcagggccucagaucucucacaugcucccucccuaagaagcucccccagggaaccagggagaggaugcgagcccacagcaacguggagagagagcagcagccuagccaaccccacauggagagagagcagcagccuagccaacccccucagacuggagcaggaaguggacaccugcaagaauggggcacgccaccuacguauucuuauuaugggguugggcaacucuaggcaaugcggaaaaacuaauaaugacagguucgcaugaaaaacccaagcaugaaauggaacgaaaagagggccuuuuaugaguuacuccaggaaaacauaugguggaggauacucagggaguccugauguuguuauuacuaggggguuggaaagcugaggcgaggguguguggugucaaaggcuuguuaacuguacaaguuaacaagucuaggaggaauaaaccuaggacaccaagucagcagggacucaggaauaagggucgccugccaguugggcagaggcagcaccagacugccacgaccacugaagcacagcacuugggagaauugacaguaacacccagccacucaggggaaggggugucacaccgucaccaacccccucgaccccagcacuguccgugauccacacaugccugcugccuccucaugcccggggcagugccgccaaccaugcccaggagaucaugcagccugcaggcagugggguuugugaugccaguaaucccaggcccuccccauugguggcuuuuuuuuuuuuuuuuuuuuuugagacagagucucacucugucauccaggcuggagugcaguggcuugaucucagcucacugcaaccucucaggugcgaucucggcucacugcaaccucugccucccagguucgagauucucuugccucagcuucccgaguagcugggacuacaggcgcgugccaccacgcugagcuaauuuuuauuuuuauuuuuaguagagacgggguuucaccauguuggucagggcuggccucgaaccccugaccucagaugaucagcccaccucggccucccaaagugcugggauuacaggagugagccaccacgcccggauuuuuuuuuuuuuuuuuaacagaccaaagcguuaagaguccccaaaggagggaagccacccugcaauggaauggcagaaccaggaugggugaaccugaagucucaggugucaagacaucggcacacagacagcuuggucucuccuaccgacaagcacaucuguggcccugcugcacauaugggcagaggguggcuggcacguccugccucggcauguuccagcauccccacaggacccuauaccuggcagccccuacaucauuuacugcuucugugacagauggagacccaauagaguuuccuaagagggagaaagaguccacagcaacccccacccucaauuccagggccucuugguacggguccuaacuugugucaugcccaggccaggugcugucacccuuucuuccaccagagucccugcacacaagccaaaacccgcuuuucagguucaucggaauuauccugugguaggagcaaaccugacuuucucagagccuuccugcuuguacacaaggggaccccucacacuuugagaaggggcugcccagcaggaggaugccaggagccaccaguggcuacuucucuuuccugaccacgcugugggcuccaacucugaggaaaaaaagucuuuuaggaagaauguuucuuucuucagugaggaccacagaccaaugguaaagguggccuucaggcauuacaccaaagaacgggacagucaacucuggcagcuacauuccccgacaccucacugugccugaacaggggcagggagaaaauguagcucugugaguucacauccguuuuguguccaugaauggauccaaccaaacugguccagaugcacaugggguccagaugccucuguggccuguacccagaccaccagccaguacuguccucggucccuugcagaucucagggauacuuuggcaugagucagggaagggaacaggcgcaggcggaagguugaucaucucccccaaccugucagagcugguguauguaacagaaucucuaagugaccugaacugacaggaaccaacagaaagacagagacaccuccaaccucuagcacaggacaaacaagcuccagguccaagauucuguucugcugacugacauccacgaauggggcucacaugaugugcucugcuuacauggaaagccagugacaucgagaguucucuuuuugagacagggccucacucugucacccagguuggaauucagugguucgaucacagcccauugcagccuugagcuccugggcucaagcgaaccucccaccucagccucccaaguggcagggaaugcaagggcaagccaccaugccuagcugauuuuuaauauuuucuauagacagggucucgcuauccugcccaggcugaucuugaacucuugggcuccagugauccuccugcccugaccuccacaguaguugggacuaugugugugagccaaugcaccccacccagaguucuuuuucaaaaagcuuuuauuaaagucaaguucacugacagauaaauuacacacaucuuuauaguucauaaucucaguuuuacuaucuaaucugaggaaacugaacaaagcugaugacuuccugaagggacucauguacauuacauaacauuuuaagaauuucugaggaacaacagccuuucaacagucauacauauaguguagaugaucaauuucgugaaagccuguguucaugucccacacgaagauuuucauuuuaagggaguccuuaaaaugaaaugcaauauggccauuuauucucaccugcacaagcugcugcuuguuuaccacaccagccaaauaaagccuauggucaucacgcuacccgccagccaaaugcuccauuucuguaggccugacauuuuucugugacugagcacugcauuacauuuugucacuauuuuaccaaaacucacguaaagggaaaacuaaaugugccgauacuggugacaggcagacacaucucacaggcuggcacaauugugacacaggugcgaaucaaaaggcaugcucagaggggaagacacaugaccgagacacuccacgcacccaaucauguugaagagacuugcaaucaugcagauugagacaaaaggauggcacacacauucuagaacucuuauucugggcugcaucugaaggcgaguuccacugggagucugcuguuuuuuuuacacaaguuucaggauguuuuuagaggagcucauuaggcauuacaacucgacacagugaccccacagccauuaggagaugagggcugcgaggcacaaggguccccucuaacacaucugcugcuggccuugaguuaagggagggcauuaucuaucaggucugacuuucagguggggcaaucagugaaauucaguuuagaucacuguuugucagcuuaaaauucaaggugauaucuuaaaucaguuuguguacugacagccagaaaugaauuccauuuuugugauuccaccucauggacugaguucugggacuauagcuaaugugaacaccaaagaaccguugcccacuagcuaauguaaacaccaaagaaccauuaccugcuuauuuguguauuucuugcuucuugguauuugugaaguguuacuucaaagcaccucaccaaacguaaguccuucugaaaucugcagaugcacagcucuaaccacacaccagguggacucccagggcugcugaaggcagugucucaugaccucugaccacagcuacaaugaaggacuugcacuggcugugcacauggcaucauggcaaaugcucuccaguccuuugugcugccccagcccugcucucucagugaugggacucuggucugucacugagcacaaggcccucuagaauaaaaccccuguuuccuggccucccugcagcugugcacaccccgugagucagcuuuguccauggaugcuuacacaaggacauggaaggggcagcagagccuggggccuaccaguauuucuacucuggcaggcagggugcaguuggccucuaccuggcccccagugcaguggcugauggacuggccacugggaaaaccaagaccaaaaacgcaaacccacauuagcccccaacacugaaacucacaacacaagcugagaauaaggaaccugcagggauuuaacacugcaacgaggaacagcuaagaaacacagcaccccuacccccaccucucccugcaggugacagcugccgggagaguacuucaaccagccccguccccagggccaaagaaccagcaguuugaggucaguuuggugcccacaggggagacccugucuccacagggcuucugaccagaaccccaacuccuaggugaggucccaaugcccuggaucauggcccaguccaauucugccaggcgccuaugcugugcccaagggcucuuccaacuugagggcaggcacucccaggggccugggcccuugugcuucacucucucccaugcaugcuaaacagcgaaugacugugcgauggcacagcaccaagccaagagggcaggacgaguguccacaucccaaccaucugcuagcagugcguuccccuguaccucacauggaggccgcugguuccagcaaugaccagaggcugaguccacagugcccaucucagcauggucagcgcacacguagcggagcuaucugaugugacaaugcuacccugguuuucaggggaguggcaagaacccaggaagagagggugauacucaguuuugccaguucacuuccugaacuacacacucaccacagacaugcugggcacugagcuacugccaggcacuguucuggacgaacauaggcccaccauuguguggggcugggggauccagggcccugaaggccccuuucuacaccacuugaaaaaaaaaaggggaacuggaacagcacacugcugguguugcugucauaaacugggagagcaaguugcuccuuccuccaaccacuagaaggggguggggcccuuguagcuucuccgcaccagguuaaagaaaauuaaugcaauggcugcaccagugauugagccaaugccuaaaacuugauuucugccuucaagaaacguucauuuuaaaaauguaggcugaggggaaacaccacacaaagacuugcucuuccagagaaaucaaaagcgaagugcaacaaugggagugggaaccaucaccagguuucccccagcuuugggacgagcaccaccuugccaccccaccccacucuggucagucagacauguaaagagacggggaugcccccccacagacccugggaggccaccgcccuugcaggaaauccucgcuucuggaggcacuccagaccuaggugagagaaaggcacaccccggggacacucuggggaccucccuucaagugaccuaguucucacacacacgcuggcaucugcccugcucuccaggugaugguggccccuacacaacgaccccacauuucucuucaagacuuuagacccuccucccaauuccugccccuugacagccagcuuugcagccgaaaccccccucccaaacccaacaggcauucuccgcugugaugcgaguagccucccuccuguuccccaggcaagaaccccgucuccagccuccuccugcguguucucagcacaccagucagccaggugacccgauguucuacucagagcugccccacggcugccgcccgaucagguccuugcaauaggcugccuugguccacaacauaaugcccacacugugcucuaaaugcugccucuggcaacccaaaaggaaguagagacagcaucccagcacucgcacaagacggcagagaaccacugcucugucccaacuaugaugcaauggggaguaaaggaaagugacuucacaaccacgcuagaggaccaaggguggcggccagagaaccacccuuaccaggcugcucaugcacugacaccaccaaccucaagggcaagccauguccaugaagcaacuacuguagcuuuuccuucuggaaacugaauucuugcugugauucugaagagaacaauacacagucaucuuugauuuauaaggugauuuuguuccuggaacuucagaacaccuguuaaaacuaugcacaaaaauuuuuuuuucauauuuauaacaggucugggacaucagacgaccuccccuacaugaaggucagacaggaaguguucuugccacugccaaaggugccagugcugccacccaaaaaugccaccacagauuaccaaauuccuuuuucugggaaccgcggacccccuccgagggccacugcacaccccagcaggcuucccacccaguaugcacccuacuccugacaggucuccaaacucugccagccagcgcacucaccucagggauucugcccugauugucccgggccacuccuucacaucucugcucacauggcaccugucaaaugacacucagccccuuccggaugguccugguaucucccugccuucccuccaccagugugggcagcucuguguggcacucaccgucacagccacugcccccguggagccucaugcucaucaagcagggcuuccuuugcccagaacaggccuuccuccccagccucccacccucuuccgcugggcacugcacaagugacucaccaccaaggagaggagaaaacaauggcaaaagaauguuuaucaggcccauagggcucaugaagaucaacuguacacaucugcagaugugcuuucccuaaaaauuaaguucgucacgaaaaaccuaucgcaucaacaaggaauugcaugcuuuuuaaaaacuguacucaugugugggucagucugaacauucuuuugaccauaaaaaugugggaaaaugggguuguagaugcuguuaacuacugaaggcaaaaguguggcagcucagugaugucagacacaagagggagggaaggauguguguucaaaaucuguuuucuaaaccugcccccagguccucagcugaugaguagguauaaauuuuuuuaagagcuaaggguccugcucuguuacucaagcuggagugcagugguuaugaucacagcucacugcaaccuugaccuccuagguucaagugauccacucuccugccucagccucccaaguagauugcacuacacaggugugagccacagugccuggcuaguacaaauauuuuaaggaaaaugucaccaccaaaauugccagaagauguauucauaguauuuuaaauauaaaucaauaaauuugauuggugagugagcaacugcauucccaucuacagaagguacaaagcacaggcacaucuaacugccuccguucccaauccccaggaugaguauagaugauagcuucuuggccauuuguaccuaaaucaaaccuauaaaauacuuaaaaguuucccgcauagcguauaugguacugcaaaaauaacuugcuguaugacacaaauggaaagaugucucaugucuagccaugcuaccacuggaagcccuuuggaaaugaaucuuucuagcuugcuggcaucccuucagggaguaaaaacuauuuuaauacauucugccuagaaggcuuucaaaauauacuauuuugaggacauaggaaaacccaaacucaguuucucacacacucuuauaacacaggucgcuucucacaccacaugagcagggguuucucccuacaugccaagcaagcaaccaguucugcguucugcagcagacaccagcuaggugucguuuaauucaguucaauucugacacugucuaccuggaggcaaucacaaacuccagguuauuuuaccugugcuucuggacagccaucuauaaaucaggguucccauaacuccuuccccuuggguucaauuaauuugcuagaguggcucacagaacucagaaaaacacuaaagguuacugguuuuucauaaaggauguuacaaaggauacagauggagagaugcagugggcgguguaugagggaagagacacggcgcuaccuuucccuccuggcugugccauucuccaggaaccuccaugaauucagcuuucuggaagcucucugaaaacccaggcaggccuuucggguauuucccaucaacaaggaauuucaugcuguuucuuuuuuuucuuuuuuuuuuuuuugagacaaagucucgcucuguugcccaggcuggagugcaguggcgcgaucucugcucccugcaagcuccaccucccggguucacgccauucuccugccccagccucccggguagcugggacuacaggugcacaccaccacaccuggccuauuuuuuuguauuuuuaguagagucgggguaucaccauguucgccaggauggucucaaucuccugaccucaugauccacccgccucagccucccaaagugcugggauuacaggcgugaggcacuacgcccagccucaugcuguuucaaaauuguacuuaagugugguucagucugaacauuccuuuguacaaauguggaaacacggggcuguagaugcuguuaacuacugaaggcaaaagugugacuucaugguauaggugugauugauuaaauuauuggcuauuggugaccagcucaaucuucagucccucuccacucugggaaaauuggaggguggggcugaaacccucuaauccugccuuggcccugugacuagcccuacccugaaguuucguaggggcugcccaucacuggucaacucauuaggguacaaaaagacaucaucacuucggagauuccaaguauuuuagccaggaaaugggaggcaggccagauauguauuuugcaauccacaacuauagacuucuaacuuccugaaauguucauggacugaaucaacucuccuguccacuucaugcuguacaccagcagugagcccugggccucaagggugugggagaaugucugccuucuaaacagaaucauuuucaauugcugugccugugaaaaucugccugccuuuuaugcuuucccugucucuucucuugucauuuaggcuucuccuguuaucagggccuguaagaagcaccacccuucccagucuguuggcugacaaccggcugcaagcccuuguuaccacugugugagaaccaggaaaccaggauuagucaaggacuuuauggcuuaucagccagccucacugucuccccaucccuguagguggcugagugacaggacccugggggaggaccugagagccuccugggaacaaagagcauccaggacaugucugucaagucgcuaacaaggucaucugacccaccugagaaugugaaacuaccuaucuggacggugcggcagcugcgcagcuguaaggcaauaaaugcaacuaugccuuagagagcuuguaacaaucacaggagaauauuaaccugaggaugaaggcaaguccuggaaucccaacaugaaggggccaaaucuuuuccaaaagaccacuucagacgcuacgggcagaaugccccuaccaaccauccacgccaaugaggagcaggcacaacacagaaaacacaaguucucauaauuuaagauccccacugcgaggccuuuucguguuucucucccaauuaucuuugacagugcacucuauuuccuuucacccucuugaauuuacggaggugaaaggucaaggggagagaaugccuaugagagacaguaugggcccgccagcccaggcuggcugcagccucuugcucaggagaauggucacagcucaggaagaaguguguaggaaagcuugguggagccuggccugugaguaacagcagguuuaaauacaccaaggagacauuuaauuugaagaaucuaaaaagaacugcuucaguucucugaaaccauggucauauacuacuccacgugugaacuugcacaaguuuuuuucucuuaggucuacuuccaugaucaccgcagcggcugacaguccauauuaaauucuacugaacugaaaaaugaaaggucaaaugcaucuuccuauaguuucaagccugucugguccguaggggcagaugagcaguugaagaugucugaauguccucuccauauugugcaagagguacagcccauagcuagaccacaugauguacaaaaccagaacugugaggggcacagaaccaguuuuugcuuuucacucacagucauugugugacucagcuguuguccaaaccaacuguuucaaaucuuuuucaacuagcaaauccgaaaaucugccucacaggcaacagcauauuccuacugcugcagugauuuggauuuauuuucaacaagauacgccugaagacaagugacagcuauucuccagucuaccaacaugugaaaacauggacaacacacucuaacaauguguccaaugagaugugugacuaacauuuacacuacucaauucuucucaauuuuggacccagcuaauaguacggcauuucaggaccuuaugguucuggcuaccuaggcagugcuggugaaaauucaaauuaaaugaggacaccauccaugcggucacacguguuagacaauggcuaacgcaacagcagagggccacaggggccgcacacaacugcaccgcggcaucucacacuccucccaacacacugcggaaaacgccagaaccaccagccuugcaacagccggcaaagaaaacugcugaccacuaguucugaaacaagaacuacaacugcccacuccaacaggggcaguggcaccaacucuacagcucucaacuaggcggcgacuucggggaccauccaaagccuccgaccucccuucuuuuccugcccgcgauuccgagugcauuucugcucaauuccugcaaagcagcaacuggcugccuggacugaaagggagugccaggaggugccgucggaaugguuauuuaacacucuaggugcgcacggcuguccagccccaaucucacacgccguaaccacccaggcugugcuccgagagagcgcuggggccggccucugcggccuagagucugcgagcaggucguuccgcaggcagguuaaagauucagguagguuaaagauucaccagcucagaagaggccuucuuaucuacugccgacaacgucaaggaaaccacccuggaguuaaagcgaagaucgaccggcccucuggaggccaccggugcccugagugcugaccccaaauugcgucucacuggugugaagggaggcacucugggcucccccggagguccacgcauuccguucagcagacagggaagggcacgggguuccuguccaccugcccgcccgcucucaccaccccugacccgguaccgucuucacagcaaacacgaacuggauggagucgggaggcgaagaugcaagcccccaccaccuacaugaccuugacggcgucucaggccgcccgagccucaguuucccgguccccgaggcggggguccgcccggaugccgcucgcucgccuguacucgggugggggaggccccacgacccccaccggcccccgcggccgcuaaucccaaccguccacgcgcgggcggccucgggaaacgagaaaggcagaggcgagggaagcaggaagcccagguuuccuggagaagagcccggcguccaagcggacuuccgggcgacgggcgggggcagggacaggcagaggaggacaagcggccgcgagcgacuucgggaaccugugaggggugcgaggagcucaccgacccgcccguccgcccagccccgacuccggccgggccccagccucagcccggcccgucugcguccgcccccggcccggcccugucgccgccgccgccgcgggggucgacgugcccuucgcgaaccucaagucgccccgaggccaguccccagcccccgccggcuccaacgucucugcggcccacaccggcccgcgccccucgcccucaccucagaggcugcugcuccgagccaggcguugguuuugcucccacaagauggcggcucugacggcggccacgucagcgccuccgggcgcggggcacgccggguaagg

SEQ ID NO: 193031 - RNA, 16553 nt, Homo sapiens
ccuuacccggcgugccccgcgcccggaggcgcugacguggccgccgucagagccgccaucuugugggagcaaaaccaacgccuggcucggagcagcagccucugaggugagggcgaggggcgcgggccggugugggccgcagagacguuggagccggcgggggcuggggacuggccucggggcgacuugagguucgcgaagggcacgucgacccccgcggcggcggcggcgacagggccgggccgggggcggacgcagacgggccgggcugaggcuggggcccggccggagucggggcugggcggacgggcgggucggugagcuccucgcaccccucacagguucccgaagucgcucgcggccgcuuguccuccucugccugucccugcccccgcccgucgcccggaaguccgcuuggacgccgggcucuucuccaggaaaccugggcuuccugcuucccucgccucugccuuucucguuucccgaggccgcccgcgcguggacgguugggauuagcggccgcgggggccggugggggucguggggccucccccacccgaguacaggcgagcgagcggcauccgggcggacccccgccucggggaccgggaaacugaggcucgggcggccugagacgccgucaaggucauguagguggugggggcuugcaucuucgccucccgacuccauccaguucguguuugcugugaagacgguaccgggucagggguggugagagcgggcgggcagguggacaggaaccccgugcccuucccugucugcugaacggaaugcguggaccuccgggggagcccagagugccucccuucacaccagugagacgcaauuuggggucagcacucagggcaccgguggccuccagagggccggucgaucuucgcuuuaacuccagggugguuuccuugacguugucggcaguagauaagaaggccucuucugagcuggugaaucuuuaaccuaccugaaucuuuaaccugccugcggaacgaccugcucgcagacucuaggccgcagaggccggccccagcgcucucucggagcacagccugggugguuacggcgugugagauuggggcuggacagccgugcgcaccuagaguguuaaauaaccauuccgacggcaccuccuggcacucccuuucaguccaggcagccaguugcugcuuugcaggaauugagcagaaaugcacucggaaucgcgggcaggaaaagaagggaggucggaggcuuuggaugguccccgaagucgccgccuaguugagagcuguagaguuggugccacugccccuguuggagugggcaguuguaguucuuguuucagaacuaguggucagcaguuuucuuugccggcuguugcaaggcuggugguucuggcguuuuccgcaguguguugggaggagugugagaugccgcggugcaguugugugcggccccuguggcccucugcuguugcguuagccauugucuaacacgugugaccgcauggaugguguccucauuuaauuugaauuuucaccagcacugccuagguagccagaaccauaagguccugaaaugccguacuauuagcuggguccaaaauugagaagaauugaguaguguaaauguuagucacacaucucauuggacacauuguuagaguguguuguccauguuuucacauguugguagacuggagaauagcugucacuugucuucaggcguaucuuguugaaaauaaauccaaaucacugcagcaguaggaauaugcuguugccugugaggcagauuuucggauuugcuaguugaaaaagauuugaaacaguugguuuggacaacagcugagucacacaaugacugugagugaaaagcaaaaacugguucugugccccucacaguucugguuuuguacaucauguggucuagcuaugggcuguaccucuugcacaauauggagaggacauucagacaucuucaacugcucaucugccccuacggaccagacaggcuugaaacuauaggaagaugcauuugaccuuucauuuuucaguucaguagaauuuaauauggacugucagccgcugcggugaucauggaaguagaccuaagagaaaaaaacuugugcaaguucacacguggaguaguauaugaccaugguuucagagaacugaagcaguucuuuuuagauucuucaaauuaaaugucuccuugguguauuuaaaccugcuguuacucacaggccaggcuccaccaagcuuuccuacacacuucuuccugagcugugaccauucuccugagcaagaggcugcagccagccugggcuggcgggcccauacugucucucauaggcauucucuccccuugaccuuucaccuccguaaauucaagagggugaaaggaaauagagugcacugucaaagauaauugggagagaaacacgaaaaggccucgcaguggggaucuuaaauuaugagaacuuguguuuucuguguugugccugcuccucauuggcguggaugguugguaggggcauucugcccguagcgucugaaguggucuuuuggaaaagauuuggccccuucauguugggauuccaggacuugccuucauccucagguuaauauucuccugugauuguuacaagcucucuaaggcauaguugcauuuauugccuuacagcugcgcagcugccgcaccguccagauagguaguuucacauucucaggugggucagaugaccuuguuagcgacuugacagacauguccuggaugcucuuuguucccaggaggcucucagguccucccccaggguccugucacucagccaccuacagggauggggagacagugaggcuggcugauaagccauaaaguccuugacuaauccugguuuccugguucucacacagugguaacaagggcuugcagccgguugucagccaacagacugggaaggguggugcuucuuacaggcccugauaacaggagaagccuaaaugacaagagaagagacagggaaagcauaaaaggcaggcagauuuucacaggcacagcaauugaaaaugauucuguuuagaaggcagacauucucccacacccuugaggcccagggcucacugcugguguacagcaugaaguggacaggagaguugauucaguccaugaacauuucaggaaguuagaagucuauaguuguggauugcaaaauacauaucuggccugccucccauuuccuggcuaaaauacuuggaaucuccgaagugaugaugucuuuuuguacccuaaugaguugaccagugaugggcagccccuacgaaacuucaggguagggcuagucacagggccaaggcaggauuagaggguuucagccccacccuccaauuuucccagaguggagagggacugaagauugagcuggucaccaauagccaauaauuuaaucaaucacaccuauaccaugaagucacacuuuugccuucaguaguuaacagcaucuacagccccguguuuccacauuuguacaaaggaauguucagacugaaccacacuuaaguacaauuuugaaacagcaugaggcugggcguagugccucacgccuguaaucccagcacuuugggaggcugaggcggguggaucaugaggucaggagauugagaccauccuggcgaacauggugauaccccgacucuacuaaaaauacaaaaaaauaggccaggugugguggugugcaccuguagucccagcuacccgggaggcuggggcaggagaauggcgugaacccgggagguggagcuugcagggagcagagaucgcgccacugcacuccagccugggcaacagagcgagacuuugucucaaaaaaaaaaaaaagaaaaaaaagaaacagcaugaaauuccuuguugaugggaaauacccgaaaggccugccuggguuuucagagagcuuccagaaagcugaauucauggagguuccuggagaauggcacagccaggagggaaagguagcgccgugucucuucccucauacaccgcccacugcaucucuccaucuguauccuuuguaacauccuuuaugaaaaaccaguaaccuuuaguguuuuucugaguucugugagccacucuagcaaauuaauugaacccaaggggaaggaguuaugggaacccugauuuauagauggcuguccagaagcacagguaaaauaaccuggaguuugugauugccuccagguagacagugucagaauugaacugaauuaaacgacaccuagcuggugucugcugcagaacgcagaacugguugcuugcuuggcauguagggagaaaccccugcucauguggugugagaagcgaccuguguuauaagagugugugagaaacugaguuuggguuuuccuauguccucaaaauaguauauuuugaaagccuucuaggcagaauguauuaaaauaguuuuuacucccugaagggaugccagcaagcuagaaagauucauuuccaaagggcuuccagugguagcauggcuagacaugagacaucuuuccauuugugucauacagcaaguuauuuuugcaguaccauauacgcuaugcgggaaacuuuuaaguauuuuauagguuugauuuagguacaaauggccaagaagcuaucaucuauacucauccuggggauugggaacggaggcaguuagaugugccugugcuuuguaccuucuguagaugggaaugcaguugcucacucaccaaucaaauuuauugauuuauauuuaaaauacuaugaauacaucuucuggcaauuuugguggugacauuuuccuuaaaauauuuguacuagccaggcacuguggcucacaccuguguagugcaaucuacuugggaggcugaggcaggagaguggaucacuugaaccuaggaggucaagguugcagugagcugugaucauaaccacugcacuccagcuugaguaacagagcaggacccuuagcucuuaaaaaaauuuauaccuacucaucagcugaggaccugggggcagguuuagaaaacagauuuugaacacacauccuucccucccucuugugucugacaucacugagcugccacacuuuugccuucaguaguuaacagcaucuacaaccccauuuucccacauuuuuauggucaaaagaauguucagacugacccacacaugaguacaguuuuuaaaaagcaugcaauuccuuguugaugcgauagguuuuucgugacgaacuuaauuuuuagggaaagcacaucugcagauguguacaguugaucuucaugagcccuaugggccugauaaacauucuuuugccauuguuuucuccucuccuugguggugagucacuugugcagugcccagcggaagagggugggaggcuggggaggaaggccuguucugggcaaaggaagcccugcuugaugagcaugaggcuccacgggggcaguggcugugacggugagugccacacagagcugcccacacugguggagggaaggcagggagauaccaggaccauccggaaggggcugagugucauuugacaggugccaugugagcagagaugugaaggaguggcccgggacaaucagggcagaaucccugaggugagugcgcuggcuggcagaguuuggagaccugucaggaguagggugcauacugggugggaagccugcuggggugugcaguggcccucggaggggguccgcgguucccagaaaaaggaauuugguaaucugugguggcauuuuuggguggcagcacuggcaccuuuggcaguggcaagaacacuuccugucugaccuucauguaggggaggucgucugaugucccagaccuguuauaaauaugaaaaaaaaauuuuugugcauaguuuuaacagguguucugaaguuccaggaacaaaaucaccuuauaaaucaaagaugacuguguauuguucucuucagaaucacagcaagaauucaguuuccagaaggaaaagcuacaguaguugcuucauggacauggcuugcccuugagguugguggugucagugcaugagcagccugguaagggugguucucuggccgccacccuugguccucuagcgugguugugaagucacuuuccuuuacuccccauugcaucauaguugggacagagcagugguucucugccgucuugugcgagugcugggaugcugucucuacuuccuuuuggguugccagaggcagcauuuagagcacagugugggcauuauguuguggaccaaggcagccuauugcaaggaccugaucgggcggcagccguggggcagcucugaguagaacaucgggucaccuggcugacuggugugcugagaacacgcaggaggaggcuggagacgggguucuugccuggggaacaggagggaggcuacucgcaucacagcggagaaugccuguuggguuugggagggggguuucggcugcaaagcuggcugucaaggggcaggaauugggaggagggucuaaagucuugaagagaaauguggggucguuguguaggggccaccaucaccuggagagcagggcagaugccagcgugugugugagaacuaggucacuugaagggagguccccagaguguccccggggugugccuuucucucaccuaggucuggagugccuccagaagcgaggauuuccugcaagggcgguggccucccagggucugugggggggcauccccgucucuuuacaugucugacugaccagaguggggugggguggcaagguggugcucgucccaaagcugggggaaaccuggugaugguucccacucccauuguugcacuucgcuuuugauuucucuggaagagcaagucuuugugugguguuuccccucagccuacauuuuuaaaaugaacguuucuugaaggcagaaaucaaguuuuaggcauuggcucaaucacuggugcagccauugcauuaauuuucuuuaaccuggugcggagaagcuacaagggccccacccccuucuagugguuggaggaaggagcaacuugcucucccaguuuaugacagcaacaccagcagugugcuguuccaguuccccuuuuuuuuuucaagugguguagaaaggggccuucagggcccuggaucccccagccccacacaauggugggccuauguucguccagaacagugccuggcaguagcucagugcccagcaugucuguggugaguguguaguucaggaagugaacuggcaaaacugaguaucacccucucuuccuggguucuugccacuccccugaaaaccaggguagcauugucacaucagauagcuccgcuacgugugcgcugaccaugcugagaugggcacuguggacucagccucuggucauugcuggaaccagcggccuccaugugagguacaggggaacgcacugcuagcagaugguugggauguggacacucguccugcccucuuggcuuggugcugugccaucgcacagucauucgcuguuuagcaugcaugggagagagugaagcacaagggcccaggccccugggagugccugcccucaaguuggaagagcccuugggcacagcauaggcgccuggcagaauuggacugggccaugauccagggcauugggaccucaccuaggaguugggguucuggucagaagcccuguggagacagggucuccccugugggcaccaaacugaccucaaacugcugguucuuuggcccuggggacggggcugguugaaguacucucccggcagcugucaccugcagggagagguggggguaggggugcuguguuucuuagcuguuccucguugcaguguuaaaucccugcagguuccuuauucucagcuuguguugugaguuucaguguugggggcuaauguggguuugcguuuuuggucuugguuuucccaguggccaguccaucagccacugcacugggggccagguagaggccaacugcacccugccugccagaguagaaauacugguaggccccaggcucugcugccccuuccauguccuuguguaagcauccauggacaaagcugacucacggggugugcacagcugcagggaggccaggaaacagggguuuuauucuagagggccuugugcucagugacagaccagagucccaucacugagagagcagggcuggggcagcacaaaggacuggagagcauuugccaugaugccaugugcacagccagugcaaguccuucauuguagcuguggucagaggucaugagacacugccuucagcagcccugggaguccaccuggugugugguuagagcugugcaucugcagauuucagaaggacuuacguuuggugaggugcuuugaaguaacacuucacaaauaccaagaagcaagaaauacacaaauaagcagguaaugguucuuugguguuuacauuagcuagugggcaacgguucuuugguguucacauuagcuauagucccagaacucaguccaugagguggaaucacaaaaauggaauucauuucuggcugucaguacacaaacugauuuaagauaucaccuugaauuuuaagcugacaaacagugaucuaaacugaauuucacugauugccccaccugaaagucagaccugauagauaaugcccucccuuaacucaaggccagcagcagauguguuagaggggacccuugugccucgcagcccucaucuccuaauggcuguggggucacugugucgaguuguaaugccuaaugagcuccucuaaaaacauccugaaacuuguguaaaaaaaacagcagacucccaguggaacucgccuucagaugcagcccagaauaagaguucuagaaugugugugccauccuuuugucucaaucugcaugauugcaagucucuucaacaugauugggugcguggagugucucggucaugugucuuccccucugagcaugccuuuugauucgcaccugugucacaauugugccagccugugagaugugucugccugucaccaguaucggcacauuuaguuuucccuuuacgugaguuuugguaaaauagugacaaaauguaaugcagugcucagucacagaaaaaugucaggccuacagaaauggagcauuuggcuggcggguagcgugaugaccauaggcuuuauuuggcuggugugguaaacaagcagcagcuugugcaggugagaauaaauggccauauugcauuucauuuuaaggacucccuuaaaaugaaaaucuucgugugggacaugaacacaggcuuucacgaaauugaucaucuacacuauauguaugacuguugaaaggcuguuguuccucagaaauucuuaaaauguuauguaauguacaugagucccuucaggaagucaucagcuuuguucaguuuccucagauuagauaguaaaacugagauuaugaacuauaaagauguguguaauuuaucugucagugaacuugacuuuaauaaaagcuuuuugaaaaagaacucuggguggggugcauuggcucacacacauagucccaacuacuguggaggucagggcaggaggaucacuggagcccaagaguucaagaucagccugggcaggauagcgagacccugucuauagaaaauauuaaaaaucagcuaggcaugguggcuugcccuugcauucccugccacuugggaggcugaggugggagguucgcuugagcccaggagcucaaggcugcaaugggcugugaucgaaccacugaauuccaaccugggugacagagugaggcccugucucaaaaagagaacucucgaugucacuggcuuuccauguaagcagagcacaucaugugagccccauucguggaugucagucagcagaacagaaucuuggaccuggagcuuguuuguccugugcuagagguuggaggugucucugucuuucuguugguuccugucaguucaggucacuuagagauucuguuacauacaccagcucugacagguugggggagaugaucaaccuuccgccugcgccuguucccuucccugacucaugccaaaguaucccugagaucugcaagggaccgaggacaguacuggcugguggucuggguacaggccacagaggcaucuggaccccaugugcaucuggaccaguuugguuggauccauucauggacacaaaacggaugugaacucacagagcuacauuuucucccugccccuguucaggcacagugaggugucggggaauguagcugccagaguugacugucccguucuuugguguaaugccugaaggccaccuuuaccauuggucugugguccucacugaagaaagaaacauucuuccuaaaagacuuuuuuuccucagaguuggagcccacagcguggucaggaaagagaaguagccacugguggcuccuggcauccuccugcugggcagccccuucucaaagugugagggguccccuuguguacaagcaggaaggcucugagaaagucagguuugcuccuaccacaggauaauuccgaugaaccugaaaagcggguuuuggcuugugugcagggacucugguggaagaaagggugacagcaccuggccugggcaugacacaaguuaggacccguaccaagaggcccuggaauugaggguggggguugcuguggacucuuucucccucuuaggaaacucuauugggucuccaucugucacagaagcaguaaaugauguaggggcugccagguauaggguccuguggggaugcuggaacaugccgaggcaggacgugccagccacccucugcccauaugugcagcagggccacagaugugcuugucgguaggagagaccaagcugucugugugccgaugucuugacaccugagacuucagguucacccauccugguucugccauuccauugcaggguggcuucccuccuuuggggacucuuaacgcuuuggucuguuaaaaaaaaaaaaaaaaauccgggcgugguggcucacuccuguaaucccagcacuuugggaggccgaggugggcugaucaucugaggucagggguucgaggccagcccugaccaacauggugaaaccccgucucuacuaaaaauaaaaauaaaaauuagcucagcgugguggcacgcgccuguagucccagcuacucgggaagcugaggcaagagaaucucgaaccugggaggcagagguugcagugagccgagaucgcaccugagagguugcagugagcugagaucaagccacugcacuccagccuggaugacagagugagacucugucucaaaaaaaaaaaaaaaaaaaaaagccaccaauggggagggccugggauuacuggcaucacaaaccccacugccugcaggcugcaugaucuccugggcaugguuggcggcacugccccgggcaugaggaggcagcaggcauguguggaucacggacagugcuggggucgaggggguuggugacggugugacaccccuuccccugaguggcuggguguuacugucaauucucccaagugcugugcuucaguggucguggcagucuggugcugccucugcccaacuggcaggcgacccuuauuccugagucccugcugacuugguguccuagguuuauuccuccuagacuuguuaacuuguacaguuaacaagccuuugacaccacacacccucgccucagcuuuccaacccccuaguaauaacaacaucaggacucccugaguauccuccaccauauguuuuccuggaguaacucauaaaaggcccucuuuucguuccauuucaugcuuggguuuuucaugcgaaccugucauuauuaguuuuuccgcauugccuagaguugcccaaccccauaauaagaauacguagguggcgugccccauucuugcagguguccacuuccugcuccagucugaggggguuggcuaggcugcugcucucucuccaugugggguuggcuaggcugcugcucucucuccacguugcugugggcucgcauccucucccugguucccugggggagcuucuuagggagggagcaugugagagaucugaggcccugcaguuugggaguuauuuucauucuccccuaacacuuguuggauacuuuggcuggguauagaauuaaaggguuucgaaagcaguguuucagagucuuccauucucuggggcaucagaggugucauuugccccugugcauucuggaguccaccuugcaccuuuauugggucucaucuagguccuuggcuuugcgcuucagcccuuugaggccgaagcccagauuccuggguccccacucuggaacagggaaaaauuucaccccguaauuucguacguucuuucuuuuuaggguuucuguugguugauaucuuaaguuacuccucaucuuccuuuuucauucuguuuguuuuuguucugccuucugagcaccuucauuuugaauuuuccuuuucagcuauuuguguaucuaucagguuucucuccuuguccuuuguuaaaauaguauucugucuucagucuccugucuugguugccuccuugcagauuccuuuuauauuugggucucuuauguugguggccuuucaaaggcagacaggccugucucuugguggggggugggggugggcggagcuccaguugcuuguguguggaucugcuggggcauauagaacucucaggaauuauucuggaauuucauggcucaaguguguugucauggcucagcgcaggccuaagcccugcugcagcugcuccccuagaccaagcuuguccaacccuuaggccgcauguggcccaggauggcuuugaacccgacccaacacaaauuucuaauaaaacauugagauuuuggggguuuuuguuuugguuugguucaccagcuguuguguuaguauauuuugugugugguccaagacaauucuucuuccauuguggcccaggguagccaagauuggacauugcugcccuaggcagucccagcuucaucccuugggucccaggcgguccaguuuucucugccuggucaaucaucacauccaaggucuuccucccuuuucucucugcccuucaaggcgugugugucauuuuggugucuucauugguagugguugcaggaguggacugagagggcagguauucagucucuucugugcuccaugggugguggucuuccucugggcuuagaaaaccuggccguccccaaaaagggaacacuacagugaagguccuuauaaauuucagaacucauuuaaauuucagaauaggugacauguucaaaaccaagagcaaaguguccaaaggacacugauccagcuugaagggguucuguggcucaucugggaugauggcaguguuaaaucagacacgggcggccaguucacacccacugaaacacacaggcaugugugggcucuugcugauguugagaaauggagaagaggcauuuccuugccguagcgugcuggggugacuggaugagagagucaccagcggacagucauggcugugauucagccaaaagccaccuguguguggaaccccugguggaggaggucugaugaggggugggugugcucacaggcuccuggcauguccucuugaaggcagaagccuuccucacucgggguaagccccgcuugcgggugcagugaagaagcagucauuguuucagaaagugaccaguguuuucuaaagucccuguucgggauaaaaucaccugauucgugaaauugcccacuggccagugaggccaaagccuaacaacuucaguguccucacagaggcgucugggcaguggaggcccuuccugcuggagucuccgcagggcucugauggugggugccagcugacuuaauugcuguccccgauauuuguguucugcugagggaaccccuacccuugcgguguggggcagacauggcgggcgugccccaucgaggcuguguccucaugggagugugucccugaagguguccugcugagucuggcguggcccugugugcucugguccuugugagugugggcaggcacagugaguggugcucucuggcccuggaagguucuguguugggguguagaggagccuugcacgcaccuggaagccaguccucaggcagccagccuccccuccugcauaggcugggaugaggcagccuuucuggccaugcagcuguggggacagcuucccaagaugagggcaacaguuucucaauuccugacucagccauuuucccucagcccccauccugagguggauuuggggggcaugggaggcagggcucuuucccuguuucccugcaggcuuccaggagguggggugaggcaguggugcaucccuggguggguggguucugagcaaccacugcugggcagcacagaaccagacauggagcaccuugucucuccaggugucccuggccaguguccuuccaccuguccacaagcauggggaacaucuucgccaaccucuucaagggccuuuuuggcaaaaaagaaaugcgcauccucauggugggccuggaugcugcagggaagaccacgauccucuacaagcuuaagcugggugagaucgugaccaccauucccaccauaggugaggugggggccagcagggagugggcugggcugggcugggccaagguacaaggccucacccugcaucccgcacccaggcuucaacguggaaaccguggaguacaagaacaucagcuucacugugugggacguggguggccaggacaagauccggccccuguggcgccacuacuuccagaacacacaagguaaguggcuggggccuggucccaugggcacuccugcuucuagagagggggggccagcccauagauggggcaucgaugcccauagaugcggcaggggggcuguguucccaugaccauuugacacuggcugcccggcaggccugaucuucgugguggacagcaaugacagagagcgugugaacgaggcccgugaggagcucaugaggaugcuggccgaggacgagcuccgggaugcuguccuccugguguucgccaacaagcagguaggcgcccgggccagccuggggaaugugaggagccaguguggguuccgccuggugguagggguuacuggaggcugguggggccccuuucucuguccuguggacagcccuucccaccaacccuuccuucccccaggaccuccccaacgccaugaaugcggccgagaucacagacaagcuggggcugcacucacuacgccacaggaacugguacauucaggccaccugcgccaccagcggcgacgggcucuaugaaggacuggacuggcuguccaaucagcuccggaaccagaagugaacgcgaccccccucccucucacuccucuugcccucugcuuuacucucauguggcaaacgugcggcucguggugugagugccagaagcugccuccgugguuuggucaccgugugcaucgcaccgugcuguaaauguggcagacgcagccugcggccaggcuuuuuauuuaauguaaauaguuuuuguuuccaaugaggcaguuucugguacuccuaugcaauauuacucagcuuuuuuuauuguaaaaagaaaaaucaacucacuguucagugcugagaggggauguaggcccaugggcaccuggccuccaggagucgcuguguugggagagccggccacgcccuuggcuuuagagcuguguugaaauccauuuuggugguugguuuuuaacccaaacucagugcauuuuuuaaaauaguuaagaauccaagucgagaacacuugaacacacagaagggagaccccgccuagcauagauuugcaguuacggccuggaugccagucgccagcccagcuguuccccucgggaacaugagguggugguggcgcagcagacugcgaucaauucugcauggucacaguagagauccccgcaacucgcuuguccuugggucacccugcauuccauagccaugugcuugucccugugcucccacgguucccaggggccaggcugggagcccacagccaccccacuaugccgcaggccgcccuacccaccuucaggcagccuaugggacgcagggccccaucugucccucggucgccguguggccagaguggguccgucguccccaacacucgugcucgcucagacacuuuggcaggaugucuggggccucaccagcaggagcgcgugcaagccgggcaggcgguccaccuagacccacagccccucgggagcaccccaccucugugugugauguagcuuucucucccucagccugcaaggguccgauuugccaucgaaaaagacaaccucuacuuuuuucuuuuguauuuugauaaacacugaagcuggagcuguuaaauuuaucuuggggaaaccucagaacuggucuauuuggugucguggaaccucuuacugcuuucaauacacgauuaguaaucaacuguuuuguauacuuguuuucaguuuucauuucgacaaacaagcacuguaauuauagcuauuagaauaaaaucucuuaacuauuuca

SEQ ID NO: 193032 - RNA, 19809 nt, Homo sapiens
uuagagagguguuuuuauucuuuggggacaaagccggguucuguggguguaggauucuccagguucuccaggcuguagggcccagaggcuuaaucagaauuuucagacaaaacuggaaccuuucuuuuuucccguugguuuauuuguaguccuugggcaaaccaaugucuuuguucgaaagagggaaaauaauccaaacguuuuucuuuuaacuuuuuuuuuagguucaggggcacauguguaggcuugcuauauagguaaauugcaugucaccaggguuuguuguacagauuauuucaucauccagauaaaaagcauaguaccagauagguaguuuuuugauccucacccuccuuccaugcuccgaccucagguaggccccagugucugcgguucccuucuuuguauccauguguacucaauguuuagcuucuacuuauaagugagaacaugugguauuugguuuucuguuucugagugaguucauuuaggauaauggcuuccagcuccauccacguugcugcacaggacaugaucccauucuuuuuuauggcugcauaguauuccaugguguauaugugccacauuuucuuuuuuuuuuuuuuaaggcagagucucgcuugguugcccaggcuggagugcaguggcaggaucucggcucacugcaaccaccaccuuccagguucaagcgauucucacgccuaggccucccaaguagcugggaugacaggugcucgccaccacgccuggcuaauuuucguauuuuuagcggagacggaguuucuccauguuggccaggcuggucucaaacuccugaccucaggugaaccacccgccucagccucccaaagugcugggauuacagacaugagccaccacucccugccaccacauuuucuuuauccuuucuaccacugauggacauuuaguuugauucccugacuuugcgauuguguauagugcugccgugaacauuuguguauauaugucuuuaugacagaaugauuuagauuccuuuggguauauaaccaauaaugggauugcugagucaaaugguaauucuguuuaaucaugucccauuugucaauuuuugcuuucguuacaauuauuuuugggaucuuugucaugaaaucuuuuuccguuccuauguccagaaugguauugccuagguuaucuuccagaguuuuuauaguuugggguuuuacauuuaagucuuuaauccaucuugaguugauuuuugcauaugguguaaggaagugguucaguuucaauccucugcauauggcuagcuaguuaucccaguaccacuuacugaauggggaauucuuuccccauugcguauuuuugucaacuuugucaaagauuagaugguuguagguguguagcuuuauuucugggcccucuauucuguuccauugaucuaugugucugcuuuuguaccagcaccaugcuuuuguaccaguaucaugcaguuuugguuacuguagcccuguaguauaguuugaaguuggguaaugcgaugccuccagcuuuguucuuuuugcuuaggauugcuuuggcuuuuugggcucuuuuuugguuucaaauaaauuuuaaugcuuuuuuuuucugauucugugaagaauguuauugguaguuugauaggaauagcauugaaucuauaaauugcuuuggguaguauggccauuuuaacaauauugauucuuccuauccauaaguauggaauguuuuuccauuugugucaucucugauuucuuucagcaguguuuuguaauuuuuguuguagagaucuuucaucucccugguuagcuguauuccuagguauuuuauucuuuuuguggcaauugugaauaggauugcauucuugauuuggcucucagcuuggaugucguugguguauaaaaaugcuaccauauuuuguauauugauuuugucuccugaaaguuagcugaaguuguuuaucagaucuaggagcuuuugggccaagaucaugggguuuucuagauauagaaucauaucgucugcaaacagagauacuucgacuuccuuucuuuuugguugccuuuuauuucuuucucuugccugauugcuguggcgaggacuuccaguacuauguugaauaggacugaagugccuuguucuacuucucaagaguaaugcuccagcuuuugcucauucaguaugauguuggcugugguuuugucauagauggcucuuauuauuuugagguauguuccuucgacgccugguuuguugaggguuuuuaacaugaagucaaguugaauuuuaucaaaagccuuuucuguaucuauugagaugauacgugaguuuuguuuuuaguucugccaaaccuuuucuuuuaaagcccaacgaauaaaacccaucaccuuucacaagaccaccacagcaaguaggcaggaaugccaguguuaaaagugaaaucuuuugaauuuguaguaccuuuccuuuuccaaaucuagcugaaauuucucacuuguuuuccuuuugaugaagcuaaccaccggcauuucuccuaagaaauggauauaaaaaaaguuugauaugguuaaaguaagaagugcuagcuccuagaauaucucuggauauugcugucccuuguuacagagcaugagcccugcccaaagacuggaguguaauggcauagaaaaggucaggagcccacugagccagaaguauaggaggcuugcgacaaaguuuaacaggggccuguugcuaucacuggguggagggacagaugggagaacacucacaccauggaaucuuaggcagccauuaauaaaaauaagccacacuguuuuguuuguagggauuuccuuggguauugcugaauuuacauuaggauguaaagaaauguugcugggcgugguggcucaugcccuauaauuccagcacuuugggagucugaagcggguggaucaccugaggucaggauuucaagaccagcauggacaacauggugaaaccccaucuguacuaaaaugcaaaaauuagcugggugugguggcgggugccuguacucccagcuacucaggaggcugaggcaggagaaucgcuugaacccgggaggcagagaucgcagugagccgagaucccaccacugcauuccagccugggugacagagcgagacucugucucaaaaaaaaaaaaaaaaaaaaaaagauggcagcuuuacugguucaaaaaaaaaaaagugaaaaaauguauauaacaggacuccaaauguguauguuuguauggugguuauauaagaaauugcuaaauaaaauacaggguguccugguuaaauuuuaauuuuagcaaaacaaucauugcauggaauauaccuacacuaaaaacaauucuuuguuucucugaaauucaaauuugacugaauguccuguauuuuuauuugcuaaaucuggcgacucuguuauauaaggauggagaaaacugugaaaggaaauauaccaaauugugggaggcaaggaaaaauggcacuaguaacacccccagcaaauaugaaaugaacccauuuuuguaaaauuauaugcuuaugugcauacauagaugcacaaggaaguuagaaaaaaagguuuuggcauacuaagucuuuuguaagaagcaugcaucauauacuaagugaaaaaggcauguggcagaguaaaaaguauaguaagauaauauguguggaaaaagaaacaaguaaaacccaguauaugcuuguuuaggcuuguauaugcaaagguagagcuuugaaaagaugcccauaagacuguccaaagugguaucucaggguaugggguuggggaauuaggguuagcuuugcuuuuauacuucuuuauaugauauuauaucaacuagcuccaacaaaaucuaguacuuauguauuuugaaaaaaaauaaauuuuuuaaguaaggcauuuaaucuggagcuuaagagcauaaacuuuggagcuauauacauguggacucaggcuggauccugccaccuucuaauuguauacuccuuggaaagcuacuucaccuuaucuguaaaauggagauaaaaugcaugccuauuguuuaugaugaagauuauaaagagcucuguauuguaacuggcacacaaugguuaacaaccucuaaugccaguuauuauuauuacuagaaaauaaccuaggacauaaaaaucaugauauucagggagaugccuacaaacccugaucuucuugaagcaaaccuugaucugcuggagguaagccaccaccaacuggcuuaggaucuugaccaagacaucucaucucugggccucagugccauaucuacaccaugagagagauagacuggguauccucugauucauucauuuacucaacaguuuugaagcaguugcuccaaaucaaucccuggccuagaagcuggagacacagagaagagggaccuggcucuaccuucaaagaccuggcuugagucaaaggugacucagucucucggaggugaugcaaauaaaccaggugguaagugcuacgagauagugcauuugggcacccagagaagugggagucagagaaaacggccuuuucagccacaacauuugugaacaucuuucaggucuuggauuuuuuuaagacacugugcggaugguucccagaaagguaagcagagaacagaggcugaguaccugauguugauuuaggaucggcaggggaagcaggaugccacacugagaacaucuccucagaaugucauaggcugcuuuaucuccucuaggggagcugguccugggcuugggcucugacaucaaaaguggauccaagguuuuguuuuugcuucuuggugcuuucuuugaugaacuuucagaaugaagaggaaaucuguuuauacuucuugucuuuggacgaacaucuuucuccaucguggaaguuugauuuucagcagcuugacuuggaagagaugaaggaagaauuucuggauuuccaacaggaaaguguuucuuaaacucugagucuggacaacauuuacccugcaauugugaauaauauaucaaauuuuaaaaugacuucagcuuuaauggucagaaaauacaguagacuagauaacacaagaaauucccacuguaaacacuuuuauaugguguauaaaaugugacagacauucaauuuaauagcuggcuuugcaggaaagaaagaaaauuuugcauuccaggaaugaaggucugacugguugcuaugguuugaaugugucuccuccaaaauucaggugcugccaaugugaugguauuaagagguggggccuucgggggugauuagaucaugaaagguccucccuuuuuaaugagauuaggguccuuauaaaagaggauucaugaaguauuuggcuacagccuucuacucuuuugcuuucuaccaugcuaggaggcagcaagaaggcccucaccagacaccaaaugguggugccuugaucuugaacuucccagucuucagaacuguucgaaauaaauuuguguucuuuauuauuacucugucuguggcauccuguuauagcagcacaaauggacugguuaagcacaggaguugacacugcuuaugggagauguagggucaacuuuguaacuaggggcuuggaugacaggaaagucccauccacacagguggggauuuggaaguaagacucuauugauccugcauaaagcuggaaacuuuaaaggauaaauuaugguggguaagaggaaaaguaucagcuaaugagaaaaggaaaguggcaaggaagcuuuucuuucuugggucgguauuugaguguggagaugaaaacuuaugccccugaaaacucaaaaucacagguccaugccauuccugugugugggauuaggauuuacuuuggccucauggucugggaaucccugagcagaagaauuaacauaaacauugagaugucuggcagaagcaaucacaaaauuccucuggagggacaacagccucaaaauaggucauagaggauccucauagguagagucccaccagauagaaacucacaauccaaaauuacaaacacacaaggaagcaauccaccuugaguaagagucacagacacaaaaguagucagauuagccuccaagaaguucagguaaugcaacuauaggauagagacuguaaaauaaauuaauuaaaaaugauuaaaucugggaaaagaauaacaucucaugaaaaacagaacagguaaauuugaaauuuucuaauuuguaauuaacaaauaauaacuuuauauauuuaugggguacaaugugauauuuuaauauauauauacauugugggaugauuaaaucaaguuaauuaacauaucaaucacuucacauaccuaucuuuuuuuuguagugagaacaaaaauaggcaaauuugaaagaaagauaaauugaacuucuagacaugaaaaaugcagguauugaaccuaaauggaugggcuaaaaacagaaaauuagauuuggccaagaaagaaugaaugaacuuggagauaauuucaggaaauuacccagaauauaagagauagaaauagagaaaauaugaaagguuaagagacauaaggcgauuaaaagagagaaaugaaaaaaaaggagagucaugaaaaaaaagagagucaugaagcuagaaugagaaugcuuaauauacauguguuauguuccagaaggagaguugagagaaugugggagaguuggggaauguugggaauucaaagagauaauagaugagaauuuucaggccugauuagugacauaaaucuuuauauuaaggaaagagaaauccugagcaggagaaaagcaaacacauuugaguacauuguucugaacagaaugaauaaaaauaaaacuacucuuaaacacguuacagguaaaaggcaaagaggaucuugaaaucaaccaaauauaaagauuacguacaaaggaauggcaauuaggcuggaagaaaauacaucaacagcaauaacagaagugggauggcaguggaauaaucuucaaaaugauaagagaaaauagcuguuaaucuagauuuugauauccagcuaaacuaucauucauggaugcaaaaaacaaaaagcuuauuuucaggcaacuaaagauuuacuacucaagguucuuggugaagaagcuacugagauguauuucaggaagagagaaaucauacccagaaggaaagcuuaggauccaaggaagaaugugaguaaagagaaggguaaacuugugaguauauccagccgggcacaguagcucaugccuguaauccuagcacuuugggaggccgaggugggcagauuaugugaggucaggaguucaagaccagcuuggccaacauggaaaagcccaucucuacuaaaaauacaaaaauuagccagacgugguggcacacaccuguaguaccagcuacuugagaggcugaggcaggagaacugcuugaacccaggaggcgaaggcugcagugagccaagaucgugccacugcacucaagcccaggcaacagagugagacuuuugucucaaaaaaaaaaagaaagaaagaaagaaaaaaagcaaaaacaaaaacaugugaguauaucuaaacaggcaugaguuacauaaauaacaacaauaaucaguaaagagggguaguaugaaagcaaaaugaaacaaaauucuggcagcauuuucauguaagauaguuacaguguuaacauguucucaaaucuauauacuauuuguaaggaaaguagagauaaugacuaacuuuagacuuuauuaagucaaguauuuauauuaaaauguuaaggguaacuauugaaaugauagaaauaaauguaaaauugacgaaucaguaggaaagaagaaagagaauaaagaaaucuugcucaauccaauagaauacaagggagaagcaagcagcagcagcagcagcagcagcagcaguaguaaugaacaagagugguaaaugcaaggccccaaaacgaugggggaaaauuauuguuaacaucauugagagugauaaaggcauugugauuaagaaaaugacuguauuuuugagauauuaaagaaugauggugaaauaacaggauaucuuggauuugcuuuaacauacuuuagaaaaaagaaaacaaacaaaguauaguucaagccuggaaaacuuuugauuuccacguguuaacagcuauuuucucuuagcacuuugaagauuauuccacugcauacccacuucuauuauugcugucgauauauuugcuuucagccuaacugccauuccuuugcuuguaaucuucuucggcugauuucaaagaaaucaaccuuugccuuuuaccuguaauguaucuaagaguagauuuauuuuuauucaccuuguuuagaacaacaacuguuguaucuggggaguaaauacaugaauguuuauuguauuaacuuucuacugucauauuuauuugaaaguuuuuguaaucaauuuuauuucuuuuauuuuuaguggacaaguaauaaugauacauacuuauagaauacagaaugauuuucuaauacauguauacaguguguaguggccaaaucagaauuguaauaagauuuuuaauaaacagauuaagauggucaauagauucuauagccacccaagcuuucauuuucagacauauaaggccuaaaaaauuugccucucaugcuuucuuucucaagaaacuauuuggggauauguucuaucaaacaaggaguaaccuaagaaagagaaagaugagaccugagauuugggaaucagaacuccaaccguggagagaguggaagaaauuccagaccaacagcuaaucaucaagccuggggcauaacaugcucccaaaaugaaauggacagacuaucugauguguguaguuguacucaggggaauuuucagaucugguagagaauuuuagggaugauuuagugauagguaccuagaaagugaagcaaaugaaaaaccgaagcaauuauuaaguccagguaaaacaaaaaguuguaggagaaagaacacauaaucacaauucauguggaaaaccauuuauaauguuuacaugguuauacuaauguaauacugaauauuuauuuaaccagaaugagugaaaucaauacauuggaaggaugaaaugaagaacuuuggaggugugugugugggaugggugguauaaaaaagugaaaucuauauuccuaaauccuuaugagucaauaaguaauaucuaaaacuggaaaaaauauaagaaggugcuuuagacauaugaaggugauuaccagaagaaacagcuaaaagcaaaaguagaguauuugugucuggggaguaguuagcaugaaggggaccaguggggcuuauaguuuuucugaggucgugggagacaauuaacaagggccauaauaaguaaguaaauuagauaauauguuagaaguuggcaaaugcuauggaaaaaauaauagaagaagguaagggguugguaaauaugugauggagagggaguugcaauuuuaaauagguuguugugguacaucuccuugagaaggugccaucugggcaaagacuugagagaagugagagaguuagcuccuggaguaggguggggaaggugaggagguagcuuccagccagaggcaguagccagugaaaaggcccuaaggcaugguaugcucaagaaacaaucaggaggccagugagcugaacaggaguaguacaugagaucaaagaggugaugagauaagaagggaggcaaagaugacauagaucucuaaagccacuguaguuuugaguuugcauaaaauggggcaagaaucaguacagagaucugaacagaggagccaaacaaucugacuuguauuuuuaagggaucacguugaccucugugaugagaauagacuguagggggcaaggugagaaguaggaagaccguuuaggagacugcugcagcaucugggcuagagaagaugaugguucauaccaggguagcaaugcggagggaaagagaagucgagagugaaccugagauuuuggccugaacaacuggaaagauagaguugccaucaacugagaugggccaagcuguggcagagaggauuccauuucagauguguuacauuuaagaugucuaucaagcauucaagugaagaugcaguaaauaguaauauacaaaucuagaguuuggggagaaaaacccagacugagauauaaauuuggaagugucugacuacauauggcuuuuuaaaaaauuuuuaaauuuuuauuuauuuaucuauuuuuugagauggagucucgcucugucgcccaggcugcaguguaguggcgugaucucggcucacugcaagcuccgccuccuggguucacgccauucuccugccucagccucccgaguagcugggacuauagucacccaccaccacacccggcuaaguuuuuguauuuuuaguagagacgagaguucacuguguuagccagguuggucucgaucuccugaccuugugauccucccaccucggccucccaaagugcugggauuacaggcaugagccaccauacccggccuuacauauggcauuuuuaaaaaucaggagguaggaugaaauaaugaaggcagugaauauagguagagaagagaccagagacuaagcccuggggccccccaaaauuaagaggcuggggagguagagaaugagagaccaccaauguccuugaaaaccaggaaagugugguacccuggaagccgagaaaguccacugaggaagagggagugaugagcaguaaaugcuucccauaaauugagaacugagaacugagcauuggauuuagcaaugcagaggucauugauuuugacaagagcagauuugguuaaaauggagagccagacuggagugggaauaagaaugagagaagaaaagauggaggcaguuacuuauagacaacuagcucaaauguuuuucuacggaggggaacaaagaaacaagaugguagcuuauaggaaaugggaucagaaguauuucauguuuuucuggcuuugggucauauuaauaaaaaguuaaagacugaaaaccacaaaaccaccuaguauacaugauuucaauccuuaauuuucaaaauuaaaaaaaaauucuuuucgugcaaggccauugauauauaaauauucaauagugguaccccuuuaaaaaguuauuguaagaaauguuaggacaaccuagagaugugagacuuuguuguuaccugcguguacagcucauuuaaccucucucuguugcaggacagagaggggagaauugcuggagcaguguagcaaaaaacuugugugaccuuguguaggcaaaaagagaggguauauuauaccaguaggaggggauaggcuuuagagaggcacauaggaagcuccucuaugguuaagaggugggaaggcaaaguaagugaguguggaugcugccaaggagauagaucugguguuggcugguuguggaugucuucuuuuccugaacaaggagauaaaccauuauccccauuuuccucaaaagaagaaagaagcucagagagguuacacagccaguaaggggcacagcagaacuaaaauucagaguuucugagcacaaauccaguuccauguguauuggagcuccccacuucccuguagccuucaaauaaguguguaggugcccugguugccaggcuggacauuugaagggaaguagucagcuuuacucuuguuuuggugcucaccaaguauuuucucauucaaacagaacacauggaccacuuauaggaucgaauaaacaucaguacuaaggaaaacaagucaguaggugauuuccacguacagccaaggcugagaaucccguggcuggggcagcgcaucucagacuugaaaugccugggaaaucaugugacccugcauauucugauuuagcauuucuagggggagggccugagauucugcauuucuaacaggauuccaggugaugcucaugcagcugguccacagacugcacuucaaaaagcaaagagcugaaagguggaaacaauccgaauguuuaccaacaaguagagaaacaaaaugugggaugaccguaaaaaggccauuaacuuugggaggccgaggaaggcggauaaccugcggucaggaguuugagacuggccuggccaacaugguaaaaccccgucucuacuaaaaaaaaauacaaaaauuagccgggcgugguggcaggcaccuguagccccagcuacuccggaggcugaggcaggagaaucgcuugaacccgggaggcagagguugcagugagccgagaucacgccacugcacuccagccugggcaacagagugagacccugucucaaaaaaauaaaagaaaagaaaaggccauuaaaaggaaugaaaugcugacacaugccacaacuacaacacgggcaaaccuugaaaauguuacgguaagugaaagaagaugguuacauaagaccacauauuauaugagucuacugaugugaaguguccagaauagacaaauccauagagauagaaagcagauuagugguugccaggaacugggaagaugagggaauguacaguaccugcuaauggguauaggauuucuuuuuggaaugaugaaaauauucuagaaccagauugcacaacauugugaauguaccaaaugucucuauagugauggcaaauuuuacauuauacgugguuuaccacaauaguaaaaagaaaaagaaaagagcgaaaagcuggaucgucucuaugguuucuuuaguuuugauauucuguaguuuuaagcacugaaguguuaagaaagguaaacaacuuucugcccaaggagaaggagaagaguucuuuggagagaagccuugguaaguuucccaaaggggaaaugcuccauucugugcaaaagaagggagcaacuuggcacagcaaugcacuaaacggcgcuuaggggcuauggagggaagaaccugugaguguucccaggcaaaaucagucagucagucaaucacguaacugcgccucuacagaguccucuuuuugcaccaagcucugaugucaggaaaauggaaaaagucaugcaguuuugcaggaagcucacagucuaauagagaagacucccacaugggaccgaaaacaguaagacaggcccuacugaggaccaaauugcaauguccaggccaugaaguuuggagauggucagaggugaucggggguguugggaguggcaagggaagccccuuugaagggcugggcacaaaugaagaccaauuuuugugugcuugauuagccuaagcaagucacuaaacuaucuuuuggaacaaagcaaaaaauaaauaugggacccuuuaauauccaugcuauguaaaauugggcccagaaucugccuuuccuaucacacuuuucagaauguggaugaacuauuggcaccauuagaaaauuacuaagugcuacucaccauaugguggaaauacuuauuuucuggaaucauuugguugcaauaaugacaguagauuucccuuucaggagcugaaauucuuuccccugaauaagcagagaaacaacaccacaaaugauuguccuugucaacggcuagcccagcucucccacaacugcauacauggccugugcucaugagcacgaacugccccccggaccugccuggucuugacuuuccugcgcugccggcauccuugaccacacaggcaacucuuggccgaaucacccacaucauuuccuuuauggccacagaugugcacucagggcagcagcaaccguaauggagagacauuuuccuggaucaggacugguuucuaaggagaugaauggagcuguagccacggaugccaacccccuccauucugacugugcucuuucauugcaccaguuuucagacucugugaucagaccagguguugguugaacacauuuuuguugacaguguugaagcuguguuguguuguguuguguuguguugcacugaaguuguguugaagacuguguuugauucuguugacguccagccaugcugggaugaaggaaauauacaugacucucacaauuuccagguuuccauuggccaguuuugcccuuggguggauuguuuaucaggagaagguuacugucuggggaguuuuaggcucucucccauguuaccauguuaccaaaacaacuagcaaagacaccaaaggaucugucacacugaugguugugugacaguaaauacacccucauaaagaggugagugauucaagugaacauaaaaugguaccagggagccaauacauaggcccccaggccaggagccauugcuaacucccuucuggccauuguugauaauggaaaaagcccuagauucagugccaggaagugcgggaguccagucuuauuuuugccucuagcaagucccugcuuuauucuguguguagguuucucaucuguaaaaggaugcaauggaucucugccaggcuaggacugugcuagaggugcucaaagaaagccuccuguuuccuaggacuccccauggucccccccuuuuuuuuuugagacagaguuuugcucuuguugcccaggcuggagugcaauggcacgaucucgacucacugcaaccuccgccuaccggguucaagugauucuccugccucagucucccaaguagcugggacuacaggcguccgccaccacgcccggcuaauuuuguauuuuuaguagagacgggguuucuccauguuggucaagguggucucgaacucccaaccucaggugaucugcccgccucagccucccaaagugcugggauuacaggcauuagccaccccgcccagccuucuccauggccucuuuacucaacuuugugguagcuaggcucuagccccggccuccuagucucccuggaccagucauuugaaggccacagcagacacacaggaaggccacucugaggcaugguuuagaauuagaauagccagaugaauugagaucuauacagcaaauacacuugucauccguccuguugagagcuucccuuccuugcaucccauccaggaaaggcucuggcccuuggaacgucucucuuccaccccaguuugugugcuuaccuuucccgagcugggccuguucacugcgacagacaucucugugcugggcgagcaugcggugcaugaugaacuggccacagccuuggcagagcucuguccggcugccacaguaggacucguggagcuccagcuugcugagcugcauguccaguuugcagaacuuacacucaacagggcgcuccuggcacucauuggccugugggaggcagcaggaagggcaugaucacuggcccuuuuuuuuuuuuuuuuuuuuugagacagagucucauuguguugcccaggcuggagugcaguggcuugaucuuggcucacugcaaccuccgccucccggguucaagcaauucuccugccucagccucccaaguggcugggaccacaggcgugugccaccacgcccagcuaauuuuuguacuuuuaguagagacgggguuucaccauguuggucaggcuggucucgaacuccugaccucgugauccacccgccuuggccucccaaagugcugggauuacaggcgugugccacugcgccuggccgaucacuggccucuuugacuguaggcagaucaaggacuugugcccaucucccuagggaauuagggccaauacgagaaagcagaugagaagggccagagugcgggacugccuucgggggaucugagcucugauggacucauggaccauggaaaacccuucugaucaguaucugggggacaggagaaccuguguuaugcggugggcuaguucuccacugcucuccaagccuaauggggugaaaagaguggucagguggaaaucucuauuacuggccucccguuuccccuuccucuccuuuucucagguuggucuauuuggcuguaaaggagaaaucacauggggcucuuaccuuaugaaacuccagcgaggacuucugcaugcucugcugacacaucguacacccaaccuaaacacacacacacacacacacacacacaccagauguggguccacccagcacccagggccugccccacauccacuuuggcucacaguguuccggguuugggucugugaacucccagagggcagggauccgauguggcuaccucagugucucucuagcaccccgcccaguguucaagaaguguuugucagaccagucugaguuggcaacggcugccugagcuugaguaucuccagagagacagaucaggggccccaggaggaauggacauggaaaggcgggaaacagggcuccaucugacugccuuccaggaccuuccuuuuucacauccucucuuuacagaucucaagagaacagccagucuuuccugaaaccagaaccucuugccuaugccagauccauaagccuguagggaaaggauuggaaauaggaaaacuggagguagacucagauuagcaugaaaaaggcaggauuaacauuuccuuuccaugggcuuuguguggaggggcuaaaugacuucccauggcccucaagugagucucugccugggggacuggacccuugccuuaaguccccagcccucaccccaacucccggaccccaucucuccugcagggaggacuggagccauucccugacucccagaccccuucuuucuugcagggaggauggaacacuugccccucccagaccccaucucaccugcagggaggacuggacccucgucccccaacucucagaccccaucucuccugcagggaggacuggacccacucugugacucccagaucccaucucuccugcagggaagauggaacacuugccccucccagaccccaucucaccugcagggaggacugaacacucuccuugacucccagaccccaucucaccugcagggaggacuagacccucgucccccaacucucagaccccaucucuccugcagggaggacuggacccacucugugacucccagaccccaucucuccugcagggaagauggaacacuugccccucccagaccccaucucaccugcagggaggacugaacacucgccuugacucccagaccccaucucaccugcagagaggacugaacacucgccuugacucucagaccccaucuguccugcagagaggacugaacacucgccuugacucccagaccccaucucaccugcagagaggacugaacacuugccuugacucucagaccccaucucaccugcagagaggacugaacacucgccuugacucucagaccccaucucuccugcagagaggacugaacacuugccuugacucccagaccccaucucaccugcagggaggacuagacccucgucccccaacucucagaccccaucucaccugcagggaggacugaacacucaccuugacucucagaccccauccucccugccgccuccucaccugcuggugcucaagcuugcagugcuccuccaugguuuccuuggggacaggcuccucacacuccggacacaggaccaggaaccgcaggcaguaagccucauggagggugaaguuggcagagacuacaugucuuuuacuacagggucaagguguggggauagaaaaauagacuuauuuucauauuauaaaacauggagcuguauuucauacccagggcuagaucuccagaggccuuaagcacugaacaugugaugaugaugacaccaccugccccacacucccuguguggguccaaaagucagaacagugaggcagcaucuaauaagaauaaggaugaucuacagagcucuuacauugcuggggcagggcaugggaaggagcaggagggaggaauuacaaaggggcauggggagcuuuuggggugacaggaagcuucauuaucucaauuacggggaugguguuucauggauguauauaacuuaggccaaaacuuaucaauugcuacccuuuaaaaugugagguuuauuguaggucaauuauaccucuauaaggcuguuuuuaaaaugaaacauuucauuuuaaauaauguaaauaauuaaauuauuucaauuuaaauaauuugagagaagugccaaauucucuugaaucuuuuuucuuguuuucuggugccccuguuugguccacaguguuaggaacgcagcccugcuaggcucacgcuuccugccagggccaugccaacuuccaaaaucuccaaagcgagagcuucccaagucuccccugccuucagguucaccugcgcuaacucacagagacuccgagguucuuccuggagaccacagugaaggaaggguucugagccucccacuuccugggcagggcauuuuucucuaaccguccuuuuugccaagaagugcccccuuuuggcugggugugguggcucaugccuguaaucccagcacuuugggaggccgaggcggguggaucaccugaggucaggaguuagagaucagccuggccaacauggugaaaccucaucucuacuaaaacaauacaaaauuagccgggcauggcggugcacgccuguaaucccaacuacucgggaggcugaggcaggagaaucacuugaacccgagagaugaagguugcagugagcugaaaucgcgccauugcacuccaggcacuccagccugggcaaaaagaagcgaaacuccaucuuaaaaaaaaaaaaaaaagaagaagaaagaaagaaaugacuccuuucauuuccaucagcucuugcuuguggcagcuugggagaagggaaaugggguggcuguagccguaaaggcccaggggacgagaagaguuacaugcccauguuccuggcacaggggacgugcuccgagagggacugucaaagccucacuccucuucugcccaggcagcgggcacacaggcagcaucaucuucccuuccucugcucucucuccucugccugaccuggccccuucucccccugcucuuccugggcugguugagaaaccagaguacuugaagggucuggcuggagcaaagcucucuggggaggguccacucaggucccugucacagguagggagcuuugagaauggggcuuuuugaucggucagauuccgcgcccccccucccguuagagguguggucccagcccccugcucuguccccccugccccgccccacggcucccuuuccaaggagggugagaguaguccuggagaaucuccgugggacacuuucuuucacagaugggugugaaggucauaguaucagaaccccaaauuaggacccaaggucucacaaguaugaguagcccaguugggaccacuggccgggcuauuuggcuucagaacugucccagaaagccuaacauuugggggaaaggggcugcagugaaguggagguaaugcugcccacccccacccagagauuaccaaguuuaaacccuccuacccuuggggcccacggucuccagcugcuuguccuccuaaguguucuuaugcaggaaccacuuucugcucccuucagaaacagcccuaugucgucuacgucucucccucgccagcccgggucugccgcuggagaaagcacuuucuuaccaguuccugcacaccgagaagucuccuuccauguucugcucucugcaggcuuucgguugaguuucguuucuugcaggcaaggaaacaaaacugaaaguuuuccgauggcccagcccacagcuucagggagggaggagaucuucagaauucucggcucaggaguuccccuugauuccugaggcuggacccucccaagaagccccuuuacagcauggccagccccugcugucgcccuuggccgucauucuuugcugcugucacagccgcaucuacc

SEQ ID NO: 193033 - RNA, 106292 nt, Homo sapiens
aaaugagagacagcgccaaccagguacccgcgaggacgaccccgccccgcaggacagggcaucuccaccgcgcgcuggacggaggauacaaccgaguccugcgcgccccgugcgccgggggucgcucccaggccgaggucugacagugucgccgaacgcgaaaggaagcgugugguacccgagagaggaagcacccucgucaccccggccggcaccgcauugaggcaggugugcaggugcgguugcggcgagccaggugagcgccgcccgggagccccaaggucccgccgggucugagcagcaccggguccucggaagcugagcgcggcccccggugcucgggaccuggggggcuggggccgcgcuugccggagcugcgggggggcggcggcugcacgcgucgaaccggcgggcgggggcgcggggggcgaccugggcuccgcugggggacccgggccggggauggggcgcgcagaggccgcggccaggacacccccagcaggugcccggcgggaacaaagcgcggcgggcggcgcguaccugggcacgcagcuggggcuggagccguccaccucccagguggcgaacagguucaugggcacgggcguguugagcgcgccgggcgcgccggggaggccgaggcggccucgcucggccauggcgccggccccgccgcucccucggcggccuggggcugcggccgggccgcggacgcgcggcgggcgggccgggcgcgcggagggcggcggcgcggucacauggcugccgggcggcggaggggacgggccgggccccggcgucggacaggcccgcgggcggcgacgagcugcggccgcuccgccccgccccgcccggcgccccgcccgcgccccgcgcgcccccggccgccccgcgcgcgcccggcgcccuccgacccgcgccggcgccgccgauuggcugggcggggcgccagcucgccgccucggguccaaucgccgccggcgcagcgcgcgccggaagugaggugcgcgcgcgcuuccuccggcggcgccucacggggcguccccgcccgccggugcgcgagagcgcgcacucacgcgccugcgcacagaccccgcccggggcgccccgccccgccccccgggagccgcgggcaagggccgggagagucguggggguccaccgggucccggccagcuucaggcgccgcccccuaaggaaagcucaucgucgcccuggcgaugcccaccuccccacgcgcggauuccccggccucgacacuuucccgccuccaccccgccaugccccgagucuccccgccccccugcccucgccgccccuugucuccugccgacccccgcuggguuggcccggcugugcgggccccgcccguccccgagccccucccucgcgccccccugcguggguuccccgggacgcagggagguggcaaggagguggccgggccuggcggcggucgcggggacucgaagccacucggggcgccaggcugccgagcuuagccuccagggcuccagaugaccccgggcgcccucuuugcgucccagcauccuuauucagcgccgcuuuucagcguugugcucaggacaauggagaacaaaugucuggggccaaggcuggcuccuggcccugggguuaacagugaacuuggggacccaagcaaagaggaggcaauggcuagagccgcuggggcccgacguguaggcucuggggcucagggagggugcuucccccaucuguuuggcagcggcugugguccagcaccagaugccaagccgagauuuaggaaacgguuuucuggccucucuucuguuuccuuguuucacaguuaguuuacaguugcuuuucucuucgcccugugucuugucuacaaguaguuuuacugaaacaaauccagcccgagcaaauugaccuggagcugguuucuuuccuggcccacggggcuugccaccccagugccccgucagcuccuucugcaaaggcccucaugccgcugcuuccuccguugagagagcucagccuccagcuguaacuccuguaucuagaacugcaaacagcugcgacugcuuaaagucagggucccacuucggagagaacaagggacucuguguuucccacgcgccccuggcuccucuaaggugguacacugagagccaugagggucugucugaccuuggccagcugcucggcgggcagagggccgguggaucucauaccuuugagacaggguagggggagaagugacuauguccagagaggggguagccauaccccaggaggacaggcugucugugaugggagggcaggagacaggcacccauugaccccagaacugagcguacggcgcugcuggaccuggcgagcgugcaguugcagucagacggaugggccgccugacacauggugccuguguaugccagcgucuaacccaggcagggacuacaacugggggucaagugaggagaugcggggugacuaagccgugcacagcagggcuuggcaccagcugccaccauugagcggugccccuccucugugccaggcaccguugugagcccuuaagggacgugacaguucugucccaucccaagugacaaaagaggagauggcggccugugagguuaugcagcugccaggggucgggauaugacccacacagucuguaccagaguggcccgaagaacccguauggugggucuacaucaaugcuucugccaggcaggaaagcagggacacgaaacacaccaugugucacgccugcgaccacguuuauguuuguuuuuaaggugggaugguggugaugggacuguggucuucuguauuuuccaagugcacagaugucccuugggugaucagaguaacuuuuuagccagaacuuguuauuugcacugcccuccucugucggaaaaugaugcugugcugguccuucucuugagggcugugggucacaggaggagauccccugaaggcugggaggcaucccuccccaugcuaugacccuggcauggugugagcccucacccccguguuuggagcacaggugcuuucucugguagcguuuucuuuaaagcaggaacuugguuugagacaaaccucucggaugacugggguggcugggcacgguuggggaggagguccaagaagaggauccuucagagcccuggggucucaggaggacaaccugaaagcugguccuaccacgugcugcccgggguccccggagguugugggaguuauuauuauuuaagaaguuaaagcuucaagguucugaaugcuuggcuaggauuccauugguauuaaaaagacgaagccccaacccccagucaugggacaggaugggccgaggccuuuccucuguccgccuggcuucgcuaggucccuccaccuagggugaaggcucaggcuuuuccagucgggcgccaggaccaugggcugcuuggaaacgcauucaucuccucagccugggcuaagaugacacagacacacagcaggcccugcugaagucggggagugggggaggggccuccuccagggccagcacuggucaguuggcggcuccagcccacagcgccccuacuccuucuccugccaggagcugggcugaggaagcagccccacguggccaggucccugcccagcccaugcuauggcagagggacagaacugccgaaccccuagacaggcccugccgcauccacucccaugguuggagcacauggccaugacugaggcugaggaggaauggucacaaaaaagguacagcagggcccuccuccuggaggcauuuucugggaagccaugugggggauggccaagagcucuaagaccgcugagaucgcugcacccgcagccgcaccuguggacaguucccacggucacccuuagagcagcucaacugcugagagugaggccuggaaucaaccccgggguuguagaguagaacaggguuaggugagccaugauagaaccugauagaauauucuacagcuggcagaaauagugaguuaaaaguagcuaaaaacaggccagucgcaggggcucacaccuguaaucccagcacuuugggaggccaaagcgcacagaucccgugaccucaggaguucaagaccagcuugggcaauauggcaaagucccaucucuaacaaaaauacaaaaacguaccugggcaugguggugcgcaucugugaucccagugacuugggaagcugaggugggagaaucacuugaacccaggagguggagguugcagugaaccaggaucacaccacugcacuccagucugggggacagagccaggcuccaucucaaaaaauaaaaauaaaaaggccgggcacaguggcucaugccuguaaucuuagcacuuugggaggccgaaguggguggaucaccugaggucaggaguuugugaccauccuggccaacauagugaaaccccaucucuacuaaaaauacaaaaaauuaguggggcaugauggugcgcgccuguaaucccagcuacucgggaggcugaggcaggagaaucgcuugaacccagcaggcagagguuccauugagccaagauugugccacugcacuccagccugggugacaagagugaaacucugucucaagaaaacaaaaauguaugugaaaaugcauguccaugugcaguauguauuuacauguuagugauuauacauauaaaacaccuauuuucagguauagaaaaauauugauaggauacaaauuaauccaaaguguuaagaaaguaucucugugugauggggauuccauugauuugguuucuccuuuuugcuuaucuuuaucuccuauuuucuccaugaugaacauguauuaauuguguagggaaaaucaaaccacagcagggugagcugccgcuggcuggagagccgggcgccaucuggcuggggcugcgccccguccugaaaaaaccaaacgugcaaagggaacccucacccaacgcaacaaacuauugaggaugaucuuuguaagaauacugaauguuucacuaggguaacauucuuuuuuuuuuuuuuuuuuuuuugagacagagucucgcucugucugucgcccaggcuggagugcaguggugccaucucagcucacugcaagcucugccucccggguucaugccauucuccugccucagccuccugaguaggggggacuacaggcgccugccaccacgccuggcuaauuuuuuguauuuuuauuagagacgggguuucaccguguuagccaggauggucuugaucuccugaccucaugauccgcccgccucgaccucccaaagugcugggauuacaggcgugagccacugugccuggcucacuaggguaacauucuuaauaucaaaggaaaucauacaaguccauaagaccacuaaaaaauucccaguggaaaaugguuagagaagcuacaaaagauucacaaaagaauaagugagacaguugucacuacuaucacgaauuguaaauuauaaaaagaugcacauggcugggugcgguggcucauaccuguaaucccagcacuuugggaggccgaggcggguggaucuccaggucaggaguucaaaacuagccugaccaauacacugaaaccccgucucuacuaaaaauacaaaaauuagucgggugugguggcgggcgccuguagucccagcuagucgggaggcugagacaggagaauugcuugaauccaggaggcggagcuugcagugagccgagauugugccacugcacuccugccugggcaagagagugagacuccgucuaaaaaaaaaaaaaaaaaaaaaaaaaaaagacacacaucaccaccuucuccuuaaugcaggcuaaucuagaccuaauacagaccuaaggucgugaugacauccucgguguccugcacgcugcuccccuccuggguugggcgcaggcagcgcagcucccucacacagcaccuggggcaggacccagagcagcucugcagaguggcuuggcagcgucuugggagauuugccugggcucauggguaucccauggcauccugcaggugacacuggaaaugucaacagggacacagguccaggugugugagauauuucaaacagcaacaccuacagaaaggaauguccaguccaggggaaaugacaaaacuugcccuggcacauccaccccaugggauguggaauaaccagcaaaacggaacgcugccucaguuuuagcaacauggggaaauucucagauaugugauugugugacaaaucaggguguaaaguugaacacagcaugaccuggauucaggaauaaaacucuccccucuugacugugguuauccugagccccaagauuaagagggaccuugaugcauaaauuuuaacacuucuuucuuucccacaauagaauaucaucacaauaagccaggacauaacuuaaauauuagaaaagaaaggaaaacacccaggcccuaauacagaaaucagccaaggacauucacagacaucagaacagcaauuaccgcaacacgugucaaccaacacucaaccucagugcucuucgugcaggauggauuucugguuuuguuagguuuuguuugucuuuuucuuuuuuuuucuuuuguuuucuugacagggucuugcucugucaaccaggcuggagugcaguggugccaucauggcucacuguaggccagaucuccuggacucaaaccauccuccugccucagccucucaaagugcugggauuacaagugugaaccacugugcugggucccuaaggguuuuaaaaaauuauuuauuuauuuagagacaaagucauggcugggcacaguggcucaugccuguaaucccagcacuuuggggggcugaggcaggcggaucaugaagucaggaguuccagaccagccuggccaacauggugaaacccugucucuacuaaaacugcaaaacuuagcugggcacaguggcucauaccuguaaucccagcuacucagaaggcugaggcaggagaaucacuugaacccaggaggcggagguugcagugagccaagauugcaccacugcacuccagcccggacgacagagcaagacuccaucucaaaaaaaaaaaaaaaaaaagacagaaucugccucugucgugcccaggcuggaguacaauggugccaucucagcucacugcaacuucugucuccugggcucaggcaauccucccucuucagccucccgaguagcugggaccacaggcauguaccaccacaccuggcuaauuuuuguauuuuuguuagagaugcuguuuugccauauuucccaggcuggucucaaacaccugggcucaaucaauccucucaccucagccucccaaagugcugggauaacaggugugagccacugugcccggccuaauuguuuuuuugggggggacagagucucacucuaugguccaggcuggagugcuguggugugaucauaacucacugcagccucagucaccuggguucaagcgauucuccugccucagccucccaaguagcugaacuagaggcacgcaccaccacgcacagcuaauuuuuaaauuuuuuguagagacagggaucucacuuuguugcccaggcuggucucgaacuccugggcucaagcuauccucccaccucugccucccaaagugcugggaugacaggcgugagccacuguccuggccuggcccuugacuucugugguggaagguggacuggagccucaccaagucucacucgaguugcggagaacagacaggaacagggacuugccuucugagcagucugucuaccagacacauguccuccaucauacuccgcagugcuagggugggcuauucuuaucccuguuaugcagaugaggaaguagaaaccuagagagauugaagcacuugcccaaggccaggcagcaggugagaaggugagaaggccauagaagcuugcuuucucauuuccccugcugacugcugcauggggggacagggcuauugaguacccaggaguuauuuugaucaaaugugauaagaugacagacacagagacaaccgccuuugaaagaggaguuuauuacucacaguucccaggaggaggggcacguggggaagcacccagggccagucaggacagggagggggugaagggaaagggugggcaagagccuuuauugccauuuuccaggcaaggcagaggaggcaagcugagcagaauuagaacugggucauuucagugggcucugggcuugggggugguaucuagcuagcugguaccuggccuuggggugauuuagggcagggggcuaguguucaggaaugcaggagccugaugaaaggaggcaggugggacucaugaugguugcucugcauaucaaagguaugcucagccugcacgguggcucaagccugggaucucaguacuuugggaggcuggggccaaaggaucucuugagcccagcaguuugagacgacagugagcuaugaucauaccacugcacuccagccugggugacagagugagacccugccucaaaaaaaaaagaaaaaaagaaaaaauaaaguaaauaaggcauacucagaggcaaguggucagcugucucuaggaauuagcuaacccugggaggggagucccucucuagguccacgagaccccaagaugucaaagcaccacagaugagaacacgauggggcuuggcacgguggcucacgccuguaaucccagcacuuugggaggccaaggcagauggaucauuugaggucaggaauucaagacgagccuggccaacaugauggaacccugacucuacuaaaaauacaaaaauuagcugggcgcaguggcaggugccuguaauccuagcuacuugggaggcugaggcaggagaauugcuugaacccgggagguagagauugcgguacaucaagaucgugccauugcacuacagccugggcgacacagcgagacucagucucaaaaaaaacccccaaaaaacaggccaggugugguggcucaugccuauaaucccagcacuuugggagguugaggugggcagaucacgaggucaggagaucgaggccauccuggccaacauggugaaaccccaucucuacuaaaaauacaaaaaauuagccgggcaugguggcaugcaccuguaaucccagcuaaucgggaggcugaggcaggagaaucgcuugaaccugggaggcagagguugcacugagucgagauggcgccgcugcacuccagccugggggacagagcaagacugugucucaaaaacaaaacaaaacaaaacaaaacaaaacaaacccaaaaacaaaagacaccaugaaugaagaaagccuccaggaggggaaguuugcaggugccuaggcguguccuucaaaacucuaacccugcuggucaggucauuuuucucaggcccugagaaaaggaaauccuuccuggucuaaguguuacgagcacguucaguucagauuaaagcaauucucucauuucagugcaacaccuacauuacuuuccagcucucuggggcccccaugaaggaauguuccugccccacacccccagccugggccccgcucugcugcugugugcuggagucaggucuaggggcaagcccacagccucucccuguuuacagccagagcggagaucacugcacguuuccagcguccucuuuggcgcggugcgagugaggguccugccuugcagggcugaaugaggaguacagaggacccugggcacaggaagcuggugcugggugcccagugugggugcucugagggcacuggugccccuuggccgcccuugcuugacucuuugagcuugucagucaguccuaaauguuuccaagcuuccuggggcgcuugcagcauggggcaccuaaccgguccccagggcaguucuccgcauucucccucuaaccuggcuccauucuuuaugccuucacaucacguggggagcguuacucccugccucaguugguucacacugcaauggcaaaccaccacaguccaaguggcuuauaaaccacuauucauuucacaggacggugcuggcagaugccgugucuggugagggccacuuccugguucauagacagugcccucuuccugcauccucacaugggggaagcagcagacaagcucccuccagccacguuuuuucuuuuuucuuguuucuuuuuucuuugagacagguucucaaucugucgcccaggcuggaguggaguggugugaucucagcucacugcagccucaacuuucugggcucaagcaauccuccuaccucagccucccaaguagcugggacuacagacacaugcuaccacaaccggcuaaguuuuuguaguuuuuguagagucaggguuuugccauguugcuuaggcuggucucaaacuccuggacucaagcaauccucccuccucagccucccaaagugcugagaucacagaugugagccacugugcccagccagccacuuuucugagggcauuaaucccgcucaugagggaagcagcccucaugaccucaucucccaaaggccccaccucucuaaaaccaucgccuuggggcaaggacgucaacauauggacuuugggggaacacacaugauaugauuuggcucuguguacccacccagaucucaucuugaauucccacauauuguggagggaccuggugggagggaauugaaucaugggggcaggucuuucccgugcuguucuugugauugcgaauaagucucacgagaucugacgguuuuauaagagggaguuucccugcagaagcucucucucucccugcugccauccacguaagacgugacuugcuccuccuugccuuccuccaugauugugaggccucugcagccacguggaacuacagguccaauaaaccucuuuuguuuguuaaucgcccagucucacguaugucuuuaucagcagugugaaaacagacugauacaaugcacauucagaccauagcaccccuccucugcagcccaucugagcaaaggcuuaguucuggcagcacgcaccuugggccauugcccaguagagccucacccuuuuuuauauuuuauuuuauuuuauuuuauuuauugugagauggaguuucacucuugucguccaggcugaagugcaaugacgccaucucgccucaccacaacucccgccucccagguucaagcaauucuccugccucagccucccgaguagcuggaacuacaggcgcccaccaucacaccugcuaauuuuuguauuuuuuggaaagauggguuucaccauguuggccaggacggucuugaucucuugaccucgugaucugcccuccucagccucccaaagugcugggauuacaguccugagccaccgagccuggcugaaaccacacccuuuaaaccucuuaccguuguggguguggucuuccccacccucugcuccucuggccaauccuguccuguacagccugacuguccuguacugccugacuguccugcaccgcuguggccugggaggcaugcugccccuugcaccugcaggcaccucacaggcuuuggugagggagcacacgaaauaaccccucuagucugucaggugagagcaaggauccaguggccacauggccucagauuggauucuggcuuuguuaccuacuggcuaugagauuuggggcugucaccccucacauccucaagggcucccuccauaaaauggagacaacagugucugcaagcuaguguugccauaaggaugaaaugucaucauggacagagagcauuuugcauagagaucaauaauacauauuugaaaaauccccaacauuuagaaacaaaacaauacacuuccuaauaacccuuggauccgggaggaaauuaagaguggagacaaucuugagcugaaugaaaaugaaaacacagcacauugaaaugugcaggauucagcuaaagugguaauuacagggagaauuauagcaauaaaaugccuauuuauaaaggaaaagagaucuuaaaucaaugauuucaucuuucaccuuaaaaaacuaggaaaaggccaggcgcgauggcucacgcccauagucccagcacuuugggagggcgagacagguggaucacgaggucaggagaucaagaccauccuggcuaacacagugaaacccugucucuacuaaaaauacaaaaaauuagccaggcaugguggugggcaccuguagucccagcuacuugggaggcugaggcaggagaauggcaugaacccgggagguggagguuacagugagccaagaucgcaccacugcauuccagccugggugacagagcgagacuccaccucaaaaaacaaaacaaaacaaaaacuagaaaaaggggccgggugcauuggcucacguguagaaucucaacacuuugggagaccaagacagguggaucacuugaggucaggaguuugggaccagccuagccaacauggugaaaccccaucucuacuaaaaauacaaaaauuagcugggcgugguggcacaugccuguaauuccagcuacuugggaggcugaagugacagaaucacuugaaccugggagguggaaguugcagugagcugagauggcaccacugaacuccagccuggguguucucuaucucaaaaaaaaaaaagaacuagagaaagggcggggagcaguggcucaugccuguaaucccagcacuuugggaggacagggcggggagcaguggcucaugccuguaaucccagcacuuugggaagacaaggcggguggcucacuugagcccaggaguuccagaccagccugggcaaaugaggcaaaaacccaucucuacaaaaaauauuaucugggugugguggcacaugccuguaguuccagcuacucgggaggcugaggugggaggaucaccugagcccaggagguagagucugcagugaggcuugauuaugcuacugcacuccaccuugggugacagaaugagacacuaucucaauuuuuaaaaaaugaagaaacuagaaaaagggaacacauugaaccaaauuaaguggaaagaaggaucuaacaaaaaugagagcagaaauuaaugaaauagggccaugcacgguggcucaugccuguaaucccagcacuuugggaggcugaagugggcggaucaccugaggucgggaguucaagacuggccugaccaacauggagaaaccccgucucuacuaaaaauacaaaauuagccaggugugguggugcauaccuguaaucccagcuacucgggaggcugagagaggagaaucgcuuaaacccaggaggcagagguugcagugagccgauaucucaccacugcacuccagccugggcaacagagcagagacuccgucucaaaaaaaaaaaaaaaagaaagaaaaaaaagaggguggggucuuccgcauuuccuuuuuucucuuuuuuuuuuuugagacagaguuucacucuugucacccgucacccaggcuggagugcaauggcgggaucucagcucacugcaaccuccaccucucagguucaagugguucuccugucucagacucgcgaguagcugggauuacaggcgcccaccaccaagccuggcuaauuuuuuuguauuuuuaguggagacgggguuucgccauguuggccaggcuggucucgaacuccucaccuuacgugauccgccugccuuggccucccaaagugcugggauuacaagcgugagccacuacgccugguuacgcauuucuuuuuaggcucauuccuggguaugucaccggcccuauggcgauugugaacagcaccugcagauauuugagggcgugcgcagccaggguucccgcucugggcagggggcacagcgaggugacucacggguaaccacagguggccacgaaugacugcuagaaagugggaauuuuaggggaacagaaaacggagaauagcggggcgcacggggaggcucuggaaccugggcgagcggagcggcggacgccgcaaaugcggagggcggggcaggguggccccuggcgggugucuccaccucugcggccaggccccccagcgcagcugcccuggccccgcccaccacucccagagcccgggguugggucccaggucgcccucaggagccaaggccccgcccaccacgcucggcccccucgccucaagccccgcccacaguucggguccagacccaggcuccgcccccuucccccgcccacagcuccaguucccuucgcaggccgucucuccacgggaggccccgccccccacccucagccccgcauccggcugaguccucaccccaggccucgcucgccgcuggagaccgcgcucacuauccgaggaggacccuccucugccccgcguccagcuuuaguccccgacugcguucaucgccaagggcccgcccacugccuuaggucgcgucgccagccuugggucccgucgccagccuugggucccguccccggcugcacucaccgcgaggccccacccuuagcucuaguccccggugucgcccaccgacgaggccccgccccaaacuccagucccgggcugcgcucaccgccguggccccgcccccaagcgccaguccucggcugcgcucaccgguaggccccgcucggguuccgccgaagcccagcccccgcaggucgccccuccgacgccggcgcgccgcaagggaggccagcucgcucgcaguggggaggucgcggcuccaguccucgcguccccgccguggucccggugccugucccaucccgcgggcgcggccguugcgggcggcgcggcccgggcgcgcgcggcgaaucugcggcugcgaaucggcuggagcggggccucgcgagagcggcgaggccugggcggcugggccugggcgggcggcgcgggcugcuccggaggcucggguggcuugagagucuugggaggcuccgggcgcugcccgcgcggucgccggcaugacgggccgcgugugccgcgguugcggcggcacggacaucgagcuggacgcggcgcgcggggacgcggugugcaccgccugcggcucagugcuggaggacaacaucaucguguccgaggugcaguucguggagagcagcggcggcggcuccucggccgugggccaguucgugucccuggacggugagucccgcgggcuggcgcugcgcggauuucucggugcggcuuaggcgggcuggaggcggugacggcgcggccgggaccagcgccucgguaccgcacgcucugucggggcgcgcgguucugcgccgucugggcgcgaguguggauccccuuggcgagaauguagaccuucuucgcgcgccuguggacccccguggcgugcguggacuuccucgacacacgcgugggccagggcagccagcacagggaggguugaagagagccuggggagcccagaaggccccucaagcugccccucacugucacucucugugccugcaguuuuguuuucagcaaugucugguacuuagaauccgauugcugcugcccuuggccuuggugguuaccgggcggaugcccuagggccacucaggcugcugcaggccucggaggggacguuucagugaugggcaguauugcgggcuggggauggaccccagccuguggaaggagcuggacuguggccaguuucaggugguugugaauagagcugcuaaaaggauucauuugcagcucucugugugaacauacguuuucauuucucuggggaacuuagcuguauguguaacucuaugggaaacugucaugaacuguuuugugauguggcugugccauuaugcauucucaccaguugccccacaucuucaccagcacuugguguugucgauguuuuuauuucgguuguucuaacagguguguggcaucucaucauagugguauucuguauuucucuacuggcuagugauguucaaccuuauuagggugcuuauuugccaugcccgaauccucuuuguugaaaugugugcucaagucuuauuuuuuuauuuaucucgagacaggaucucacucuguggcccaggcuggugugcaauggcccagucauggcucucugcagccuugaacuccuaggcucaggcaauucuccugccucaaccuccugaguagcugagacuacaggugcaugccaccaugcugugaucauuuauuuuauuuuauuuuuaguagagacaaggucucuauguugcccaggcuggucucaaacuccugggcucaagugauacuccagccuuggccucccgaauugcugggauuacagcgugagccaccacacccugacucucauuuuuuauuuggguuguuuucuuauuguugaguuuugggaguucuuuguggauuguaguuacaagcccuuuguuguauaugugauuuucaaagcagaaguuuuuuuucuuuugagauggagucuugcucuguugcccaggcuggagugcaguggcucgaucucggcucacugcaagcucugccucccaggcucacgccauucuccugccucagccucccgaguagcugggacuacaggagcccacuaccaugcccggcuaauuuuuuuuguauuuuuuaguggagacgggguuucacugugauagccaggauggucucgaucuccugaccucgugauccgccuaccucggccucccaaagugcugggauuacaggcgugagccacugcgcacggccucaaagcagaaguuuuaacuuuuuuuuuuuuuuugagacagaaucuugcucuguggcccaggcuggagugcaguggcacaaucucguuucacugcaaccucugccucccagguucaagugauucucgugccucagccucccaaguaccugggauuacaggcgugcgccaccucacuuggcuaauuuuuguauuuuuaguagagacaggguuucacccuguucgucaggcuggucuugaacaccugaccucaagugauccgccugccucagccucccaaagugcugggauuacaggcgcgagccaccgcaccuggccuaaaucugugguccaucuauguuuuguauaaggugugcuuuguaggcugaggcucauuguuuaucuggagguccccuuguuucaacaccguuuguugaaagacugaaggccuuugcucccucggcugugcucacugggccccguccgugcaggucugucucugggccuuguguccugcccuguugaucaggugccguuuuccuuugucagcaucacacgcuuuuuuacuauaccuguuauauuguccugaaaucagauauugugagucccucaaccuuuguucuuccuuuucaaaguuguuguggcuauuaauuucccuuucucuuuuuaauuuuagaguaaguuugugcaucucugcaggucacauauucuuaccugaaaugcuugggaccagaaguguuuuggauaccagaguuuucugauuuuggaauaucugcauuauaauuacugguuaagcaucccuaaucgaaaaaucugaaaucugagaugcuccagugagcauuuccuuugagcaucguguugauacucaaaaaguuucauguuuuggagcauuuauuuuuuauuuuauuuuuuucuugagacggagucucgcuuugcugcccaugcuggagugcaguggcacuaucucggcucacugcaagcuccgccuccuggcuucacgccauucuccugccucagccucccaaguagcugggacuacaggcgaccgccaccacgcccggcuaauuuuuuguauuuuuaguagagacgggguuucaccguguuagccgggaugguuucgaucuccugaccucgugauccaccugccucagccucccaaagugcuggguuuaccagcgugagccacugcaccgggccguuuuggagcauuuauaaucucagauuuuuggauuugggauguucaaccuguacaaaaguccuggugggguuuucauuggaauugcauuaaaccucuugauauauuuagggagagcugacauuuuuucuuucuuucucuuuuuuugagacagagucucacccugucacccacgcugaagugcaguggcgcgaucugagcucacugcacccuccgccucccgaguucaagugauucugcugccucagccuucugaguagcugggacugcaggcacacgccaccacacccagcuaauuuuuguauauuuuuuaguagagacgggguuucaccacauuggccaggcuggucucgaacuccugaccucgugauccgcccucuucggccucccaaagugcugggauuacaggugggagccacugugcccagcugacauuuuuucuauguugaaucuuguaguccauggaacacaguguauguuugcauucauuuagauuuucuuugauauagucugucaguguuggguaguuuucagcauacagcuucuggacuuuuuuuuugagauggagucucgcucugucacucaggcuggagugcaguggugcaaccucggcucacugcaaccucugccucuuggguucaagcgauucucgugccucagccucccaaguagcugugauuacaggagcccaccaccacgccuggcuaauuuuuguauuuuuaguagagacaggguuucaccauguuggccaggcuggucucgaacuccugaccucaagugauccccccccacuucagccucucaaagugcuggaauuauaggcaugagcugccgugccuggcccucuggacauuuuuuagauguguaccuaagcucuauuaggaguuauuauaaguggaauuuuuuuaauuuaguuuucaacucuucauugcuuguuuauauaaauaugguugauuucuguguguuguccuguuuccuauggcuuugcuaaacuuacuuguucuaagagguuuuuuuuuuuuuuucuuuuuuuuugagcuggugucuugcucuuguugcccaggcuggagugcaguggcaccaucuuggcucacugcaaucuccgccucccagguucaagagauucuccugccucagccucccaaguagcugggaucacaggcacccgccaccgcacccagcuaaguuuuuuguuuuuuuuuuugagacggcgucuugcucugucacccaggcuggaguccaguggcacaaucucggcucacuguaagcucugccucccagguucaugccauucuccugccugagccucccaaguagcugggauuacaggcgcccagcaccacgcccggcuaauuuuuuguauuuuuagcagaggcgggguuacauggauggucucaaucuccugaccucgugauccgcccaccucggccucccaaaguccugggauuacaggugugagcuguugcacccggccgcaguuuuuguauuuuuaguagagaugggguuuugccauguuggccaggcgauccacccgccuuggccucccaaagugcugggauuacaggugugagccaccacaccuggccccuaagaguuuuuaauacacuccuugaguuuuuuuuuuuuuuuuuuuuuugagauagagugucgcucuguugcccaggcuggagugcaguggcgcaaucugggcucacugcaaccucccccuccuggguucaagcgauucuccugccucagccuccugaguagcugggauuacauaggagcccacuaccauacccggcugguuuuuguauuuguaguagagaugggguuucaccauguuggugaggcuggucuugaacuucuaaucucaagugauacaccugccuuggccccugaaaguucugggauuacaggcgugagccaccgcacccagcuuuuuuuuuuuuuucugggacaaagucucacuguugcccagacuggagugcaguggugugaucacaggucacugcagccuggaacuucuggguucaagagauccuuccaccugagacuccagaguagcuaggacuacgggcaugcacuaccaugcccagcuaauuaaaaaaauuuuuuuuugguuggggagacagggucuagggucuugcucagucacccuggcuggagugcaguggucauggcuuacugcagucguaacccccugggcuccagugacccucccagcucagccuccugaguugcugguacuacaggugcgcccuacuauacccagcuaauuuuuguauuuuucuuguagagaugggguuuugccauguugaccaggcucgucuggaacuccugggcucaaguaauucucccgucuuggccucucaaaguucuaggaugacaggugugagccaacgccaauuuuuuuuuuuuuuuuuuuuuuuuuguagagauguggucuugcuuugcugcucaggcuggucucgaacuucugaccucaaggcauccucccaccuuggccucccagagugcugggauuagcggcaugagcugcuuugcucagcgccggauguucuguugaggguuccugcugaugcuugcgugggauauuggccuguaguuuuuccuguaacguccuugucuuggguaucaggguucugcuccuuauggaauggguugggaaacguuuccucuucuauuuucuggaagacauuauguagaguugguguucuuucuuucugaaauguuugguagaauucaccagcguagccaucuggucccaaagcuuucuuucucagaagauucugcacugugguuucggcuucuuucaucacugagguucuaguuauauuuaagaugcuguguuucaccuggggugaauuagccgcuuguguugaggaauugguccacuugaccuaguuguugaauuugcccagagaguuguucgaagcauucccuuauccuuuugauaucugcgggguccacaguggccuccuuuuuccuuucagauguugguguuuugugucuuuuuuucccuuugucucucuugcuagaaguugauccguguuuuugaucuuuucuaagaacuggcuugggcuucauugaguuuucucuccugcucuucccuccccaucgucuuccaugcucauacucccuggguaucuuccuaggacugcugggcacagaguuugcagcugugucacaguugccaagacuuggaugucuguugggaugauaacaacaguaaugaaagcaaguugucauggcagcagacgcaggguuucccgggcaggcacaguguuaagugcauccgggccuggugacagcgcacugcccucacugugcccugccgggggaggauggugguguggagcagugcagagcuggaagucugucacccgggugcugucagaacaagcucagagccagcgcugucagguggccccaagacgccucugagcccaggcacacucucuggagggaggcgcaggcccagcaaccaacuguggugguccugggggaagugcugcgaggcggcggguucuuagccccuggggaccggcgcagguggugccugggccgagaguggggaggagagaggggaucuguugcucugggcagccccucugucucccaggcaggcucucuaggugcccacuuggcauccuuccucccucgucacaguggugaucacagggggcuggaaaccuugguggcuucucaguuucccuggcacacaaguaggccccagccgccccuuccuccagcuucaucuugaaagcugagcuuucucucugagcugucguuuucuagucccaaggccacugucuuuccuagguguuuugccuauuaauugagaacuaagccugauacagcuucgcaguuuacucuggaauauuuaacuaaggcaucagggcaggugaccagaggccucaggagaguccccagaggguccugaccuuggaagccaggccccacgggggaaaccacacuggugcuccagcgucccggggcacccgagcagagacugugcagagagaagggugggugaggacugaggcucagcguggcuggaggggccaggcagacgguggaguugggggccguuggcagugcccugaggaggccgucugcuccacugaggcaaggcggggcuucccugugagcccacaucaguguccugcacugugugugcccugaggcuucccucugccagcaggugauggugauggcgcccacacaccagacauccugggcuccugcuugcaggggucccuccucguccugugcaaggagcagcacaccucagugucaccagaacuuguggggguggggagcguuucccguaaucacaacuuucaguggcuucacaguuagaacuucgaagcugggguguccgugagugcugcuguuuuccguuuggggucacgaugcagccggaccuaauuugugacauggcugcaugucaccuggcgcuggcccuggagggggacaugggugguggaguugcccucgccugcugggaagcucccucugccucagagaaggaugugaccggccagccucucccugcggccugggguucugagcaugcgccuggccuccuggcggggcucuaguccugaggguggaaggcuccaggcuucugccucugcuccaugacccccagaacccuaaguuguggcugaaggugccugcucuuaggaaacgggugaauucugucccguugccaucugggugagggaggaagcugcugguuagccugcagcgugacacacguccuguuuuccguaaccaaauuguaaucacuacaaaaccagcuccuccgcaguggccuggggaaggggccugggcuugggaaggggucuggaccuggggaggggaugugggccuggggaaggggugugggccugggaaaggguugcuccugggaagggucugugccugggaaggggugugcgcaugggaagggucugcgccugggaaggggugugggcugccgugcuuggcccuguuugucagugcuccucccagaugucugaugcuacugcauccagccccaccaguaggcacacgcucuguguucccggguccccguccccagcucucagggaugcacugcggucugguccagccuccuuugggcacucaccugugggaccccugaauuccucuccauccauuacugcccagccagccaggccuccuacaggugucuccccuuaaaagaaguuuccagucagguuugguagcucaugcuuguaaucccaggauuuugggaaaccaaggugggaggaucacuugaggucaagaguuugagaccagcgugggcaacauagugaaacugucucuacaaaaacuaaaaaaacaaaacaagaaaaaaccccaaaauacaaaaauuagcugggcaugguggugggcgccuguaaucccagcuacuugggagacugaggcaugagaaucgcuugaacccgggagguggagguugcagugagccaagaucgugccauuacacuccagccugggcgacaggagcgaaacucugucuugucuucaaaaaaacaaacaaagaaaacaaaaaauaagaaaacauuagcuaggcgugguggcgcaugucuguggucccgccuauuugggaggcugaggugggaggauuccuugaguccgagagguugaggcugcagugagccgugauggugccccugcgcuuuagccugggugacagagugagacuucuuuuuuuuucuuuuugagauggagugucucucuuguugcccaggcuggagugcaauggcgcaaucucaucucacugcagccuccgccucccggguucaagcgauuuuccugccucagccucccaaguagcugguauuacaggcaugugccaccaugcccggcuaauuuuuguguuuuuaguagagacgggguuucgccauguuggccaggcuggucucaaacuccugaccucaggugauccacccgccuuggccuccgaaggugcugggauuacaggcgugagccaccacgcccggccagacccugucucuuaaaaaaaggaaguuucacagcagcaacagaaagucuccaguuaaaaaaaaauuuuuuuuugacagagucuuggcucacugcaaccuccaucuccuggguucaagcaguucuccugccucagccucccgaguagcugggacuacaggagcacaccaccaugccuggcuaauuuuuuuuuuguauguuuuaguagagacgggguuucgcccuguuggccaggcuggucuugaacuucugaccucaagugacccacccacaucggccucccaaaaugccgagauuacugucaugagccacugagcccgcccccaguuaaguugaaugagcacgugaauauuaaagguuauugcuuucucauguuggaagaauccuggugugaaauggacagugcugugcugggucuuucaggacauggagggccccuggcccgccuuucugucuguucggcgguaugggguguugcuggcuuugucggagcucagaggugccccugcggccucuggcccugcucuggcucugguggaaccgcagguccucccuugcuguacacaggggggcagucuuggccaggccccacaagaccuggccccuuccacaugucaguuccagcuaacgggaacuagcacauauuuuuuguuauagaaacacgcuauggaaaauaccaaauguuuuuagaaguagagggcauccuggcaguuucagccagagguggcacuuuccucuuucauccucccuguggguuaguguucugagguuucacacuguccacauguguccugugugugugugccugcaagugugcacgcaccagggugugaggcaagcagaagccaggaggcgcuuccagagcaggugcagcagcguggccccagggagggugacugugguguugggggacagggagaacaacacagggacaggaaacagagguccuggggugugaggaggguaugggaggcuggagggugcaagacagagugauggaggagggagggcagagguggcagguggagcguggagcugcugacgcaugcagcuuugcagugugcuguggugcaagcugauggguaugggucaaggagugaagagauugcguaaaacacaaccagaaucgaaaucaucacuguaauuuaacguggcaucucacuguggcccuguucugucagaagcacgccugcagcccacuguaccuaggcagggaaacguggcuauaauggaggcuguacggcguccccuguucuuggaagguggggcuucaggggcuuuuuauuuauuuguuuuugagauggaguuucgcucuuguugcccaggcuggagugcaauggcgcgaucucggcucaccacaaccucugccucccagguucaagugauucucccgcuucagccuccugaguagcugggauuacaggcaugugccaccaugccuggguaauuucauauuuuuaguagacacgggguuucuccuuguugguuaggcuggucucgaacucccaaccucaggugauccaaccgcaucggccucccaaagugcugggguuauaggcgugagccacugcacccagcuggcuuuuuauacuuugaucauuguccuuuuucuaauguaguguuauaugaguuauuuauuaaaagcauuauauacacuaauuagaauauagugagauuuuucuuuuucuaaagugaaaguuggugagggagcaugugcuggagaccagcaugccaggggcuacacagaauggugaucuuaauucgaacgcuuagaaaaaacaggcggggcgugguggcucacgccuguaaucccagcacuuugggaggccgagguggguggaucacuugaggucgggaauucaaggccagccuggccaacguggugaaaccucaucucuaguaaaaauacaaaaaucagcugggcgugguggcacgcaccuguaguuccagcuacucaggaggcugaagcaggagaauugcuugaauccgggaggcggagguugcagugagccgagaucgcaccacuacacuccagccugggcgauagagcgagacuccgucucaaaaaaaaaaagaauacacacugcucacaaaacaaagaacucugagggagggucggaguugcaggcaccuggagcucagccuggggaggccugggccagauuucugcagaauuuagaauuggcucaucagugcugcucaaagcccccuuauuccaggaugggucucuccugaguccugcguuucucccuggccucucuucuggauucucauaucagcaggcaccucacuguggcccugccagguccucuccagcccccacaaggagacaccacugcgaccugcuccagcuucuguuuaguuuauuauuuguucagacagguucucaccguguugcucaggcuggagugcagaggugcaucacagcucacugcagccuccaccuucuggacucaaacgaucugccugccucagccaccugaguagcugggaccacaggcaugcccuaccauaccccgcucauuuuuuuuuuguagagaugggaucuugcuauguuguccaggcuggucuugaacuccugggcucaagcagucuuccugccucagccucucaaagugcugugauuacagaugugagccacuaugccuggccuguucuagcuucuuuuuuuuuuuuuuuuugagacagggucuugcucugucacccaggcuggagugcaguggcacgaucucagcucauugcagccucgaccucccgggcucuagugauccuccaaccucagccuccugaguaguaggaccacaagcaggugccaccacacccagcuaauuuuuuucaguuuuuuuuuguagaaaugggucuccccccauccuggcuaacacagugaaaccccgucucuacuaaaaacacaaaaaauuagccgggcgugguugcaggcaccuguagucccagcuacucgggaggcugaggcaggagaauggcaugaacccaggaggcagagcuugcagugagccaagaucacgccacugcacuccagccugggugacagagcgaaacucuguuucaaaaaaaaaaaaaagaaagaaagaaagaaagaaaugggucuccccguguugcccaggcugguauugaacuccuggguugggcgaucuuccugcuccggccucccaaaguguugggaccacaggugugagccaccaugcccggccaccacuccagcuucuuuuuuacuuuauuuuauuuuuauuuuuauuuuuauuuuuuugagacggagucuugcucugucacccaggcuggagugcaguggcaccaucucugcucacugcaaccuccaccuccuggguucaagcgauucuccugccucagccuccugaguagcugggaucacaggcacccgccaccacgccuggcuaauuuuguauuuuuaguagagacagaguuucaccauguucgccaagauggucucgaucuccugaccucgugauccacccaccucggccucccaaagugccgggauuacaagcgugagccaccgcgcccggaccuucuacagcuucuugaaagccacuagguuuguggcaauuuuuauggcagccacagaaaacuaguacauagaucccaguugugacaaccuagguagucuccaggcacugcccccgucccggcaccaccuuuguuggaggccugugcucagugcuggugcccugcugcugcugccggccaccccuguggccacguuacccaccaggaggccggcucugggccucagccugaaggaggcccgggcuuugccucugcugccaccaggaaaagcugagugccaccugacccuguucagcucugaguuuccggacgggcccaguagcugccccuugcucucuucaaaacuuuucuuggcugcucuaauuccuuuuugcuuccaacugaacuuuagaaucauuuuacuggagucuuuaaagaguguuguuaguauuuguuugggauucaguuacauucauugugaagccagaggccgugccuguucugccuugucugugcugguggcugccccuggaugacgcugaggucccugccucaugguuucccuggagggccuggccccaggcuccagcgauuggcuuucugcuucugcauccuauccuuccaguguccuccgacaggcccuacacacuugccuucccccaaguggccaagguugucugcgcgucccgauugcagcagccuccaguccugugucugugcuuugucacaaaugcacuggccccugugccaaccacugagggccgacgcugcggggcggggggcacuuuccagcucuccccaucuuugggcaugccuggggccucaccuuacuguucucguuggaagaucaggccgcagcguuuggguuggugaaccuggugaacaauccacauguccaccaugcucauugggagaucaggcugcagcgaucgggcuggugaaccuggugaacaauccaaauguccaccugauguuuccagagguaccagggccaggucuuaaccccgaagcccugcagggcagaaugugguggacgucguaggcaugcugucaguuggcagagcuucggaguagaguguccagcagguucagcugcagccuccccauggguggguggacugaggcgugggggccuucugcagacuggcugguugcagugccuuggggcacaugggaugguaccugcguccccugcaguccagcagggagguggauguguucacauguggucaccaugcaggagugauaucugagugggcuggccuggggcaagggggacggccagcccaugcugugugugcaccacuugcagagguuuggagguacaucuguguucucgcccggcagccauuugacagcguccacucuggacuugcaguguguuagggacaugguuagaaaaugcagaaagugccuguaaucccagccgggcgugguggcgggcaccuauagucccagcuacuuggaaggcugaggcaggagaauggcgugaacccaggaggcggagcuugcagugaguggagaugggaccacugcacuccagccugggcaacagagggagacuccgucucaaaaaaaaaaagaaaaugcggaaagugcaguuggcccacccucaacccugcuggcugggcagagugagagaugcuucccccacugggguuccuggcucagugacggaggugcggggggccgaccugcugcuucccccaugagugcugacccccgcuuuguucucacuuugugucuguggauguuaggaaaggguuguaaaugcagaucuccaaguuuuggcugaucugucuuuuuuuguguuuccaggugcuggcaaaaccccgacucuggguggcggcuuccacgugaaucuggggaaggagucgagagcgcagacccugcagaaugguauuucccaccgcggaugcugcugagcgugcggcgggucccagagauggggaugguggugcuaggguggagggcacugacucagccauggaccucauggccugccacuuccucgucacccugcacgcccagcccaggcugcuuuccaggaggaauugugcccugaguccccuccuggguguccugcagacucugccagggcuguuuggggagaacccaguggaucccacaggauccacagccauugcuugauggccucagugagauggaggcagaaauaacacauuuauagcaguuggauauuguagugacauucucacugcguuuugucaaagugccaguucaccacaaacuggagaaaugucugcuggguuauuugucuuaugauugaguugaaaaaguucuuuauguguuuuagguacaagucuuuuaucggaugugugauuuuauauauuuuaggugcaagucguuuaucggaugugugauuuuauguguuuuagguacaagucuuuuaucggaugugugauuuauaggacauuuucagccauuucaugcguucuuuucauuuucuuuugucuuuuuauuuuucgcugguauccuuuggagcaugaaaguuuuaaauucugauaguauccaguuuaccuauuuagucucuugauggcugugcuuuugguaucauaacuaacaaauguugccuaauccaguccaaaucgugaagauuugugcuuaugauuuuuuggaguuuugcgccuuccucucuuuccaguagguuuugguccauauugagucagcguuugcaugugauguaagguaagggccugccuucacuccugcacgugcagacccaguuuucucaggaccauguguugaaaacacuguauuuugccaguuggcauccucuuggugcccuugcugaaaaucgauugaccguaaaccuaaaagcucauuucuggauccucaguuuggcuuagugacugcaugacaguccuggugcccguuccacgcuguucaggacacugaagcuucgcagucaguuuugaaaucaggaacugugaguccucuaacugcucucuuucaaaaguguuaugcugccuguuugaagucccuugaguggcaauaugaauuuuaggaucagcuugucaguuucugccaagaagucagcugggauuuugacggggauugcguuaauauguuggucauuuuggggaacacugccgccuaaacaguguaaagucuucugauaccugaauacaggauuucuuuccauuuauuugggucuucuuuaauuuguuucaacaauuuuauuaguucucagaguauaaguuuuguacuucuuuugucgaauuuagucucaguugauauguauugaucuuguaucuugcagccuggcugaacucauuuuuuaugcugaauaguuuuuuagcggaucacuuaggauuuucgguacaagaucguguuaucuuuccuuucuagucuagugccuguuuuuuguuuuuguuuuuuuuguuuaccacauugaauagcaguggugugaacagacauccucuuguccuugauccuggggaagcauccagucuucaccauugaguguggguuggccgugggucaguccaggcagggauacuuugugcuaggaucucuuuggcuucacuguuucauugaguacacucucaggaaccugaggaccacgugagggauucuugugaucggugcagccauguccugcagccuuaguguggaugcuggaagguggucgggacagguagaacaucucuuguggacagcacgucacccuggcuguuuucuccugggccaucuccaggaggccgggcucuugagcaccugccucugcuccuggcugcugcugccgacggguggccagcaccgacacaccuaggcuggcagggguaguugggcuugcgaugaucccucacagcagaguggauggauccuuacgcuucccuugugcuuuuuuccuuguccugcuguggacuuacuaguagaggaguauagucagcgccuuucuuccugacugccggugugauucuucugcaguagagagcacccucugugugauuucagucuucggaaaugcuucgagccguggccggguggaaggccaguuuuguggacgugcauguguguugggcgcuugaaugcguuuccugcaggaagcgggugcagcgcagcacaucccucuuccucuccacuggcugguucucugugucugccaccgagagugugcaugaagaccuggcacagugacuggauccguccuguccuacccacaguuuugucaguuuuuuguuuugucuguuucagggcuuccuggcacacacguuuacaguuccuccaggugggggcuggggcugcgcugcccaggggcccuccugaccucaggcugccuggguuggggcccagcucugcccauugcuuguggugccacuaggcuaucuccuuuuuuucuucuacugacuucaagauuuucuccaugugaagagcuuuguucuccacagagaauguagucuguauuuucccaaaaacucgcgguaucuuuacuagaguuggucgugccucagaccuauacaaauugcaaagaguagugucggugcagacgcgugcauugcaauaggauuggaaaccaacaacagagaaagagaaauggcucaucuuaccuuuucaaaagccuuuuaaauaccuuugguucaagaaagaaaugaaaauuggaacauacaugcucccuaauuaggggugagugucagugaagguugugaccugcaggcccaggaggccccguggaccccacucacugugugggggaagcugcggggcccccaccccucuugagucuuacuggggaugggugguucugggggacccuaugcugaucuuuguaccuggguucccaccugagguucugcagcugcagccuggguaccugcagcaucaggggccaugcccugcugcccacucagugagcucucccacccgccugccccgggccaggcaccgcuccugccugggugggguguggggcugagggaggccauugguccagccccuguccuguuuccugcugacuuuucgccggagucgucccuuuugcugccagucaggcccccugcuguggcagugauguccuccucugccuuggcuggcugggcccgccguaccuccuugcugucgaguguccugggagcaugucugugaggcagauccuaacguauuuuucaaauacuucuggagacacaagaggggauuuuggcccauuauaacuggcacauuucugaugcuuugggcucuuccugccucuuauuuuguauuucguauuuaucuuaccuuuuguuuguuuguuuguuuuuugagauggagucucgcucugucacccaggcuggagugcaguggcgcgaucugggcucacugcaaccuccgccuccuggguucaagcuacucuccugccucagccucccgaguagcuggaguuacaagugcccaccaucacgcccggcuaauuuuuguauuuuuaguagagacgugguuuugccauguuggccaggcuuaucucgaacuccugaccucaggugauccacccgccuuggccucccaaagugcuugaauuagaggugugagccacuacaccuggcuguauuuaucuuacuuuuaaaaaacccuuuauuuugauugauugauuuaucauggguuauguuuguuuaaauuuuguuuauucuccuuuguucuccccauaccgccuugguugaaguuuucauaucagcccuggucccgcugcaagcuuggcccacggccuccacucccgcccgccacccagccugccagguuugguggaaaucugugaauguagcuuccgacuguuacuguuuuggugaagucuugauugccuuucuuagaaaacugcaaagauggaaauaaacucacgggccacccuuccugcccgcagcgacagucauguucugcgaggacucugucuccucugcuugccuccgugcacccugcgaggucacaggccccuccuuugguuugcuggggacacgcugagacuguauuuagagaaagggucugggagagagaaacuccugccccuucccccugggaugguugccaagggguugagacaggcaccccauggaauguggggagcaucugcuccggguccaccagcaagagacguugaaugccaguguguuuugaucucuguuuuuaaaaucucaggccuuuugggaugauuucuuugauguucugaagcgacgguucugaaaugccgcuagguggggcucucuucauugaccugaugagccuuucguuugggacgcguuucucagggaaauucuuuuucuguucucuuggucuguuuuuccuaguauagcacgcauaguaaagugcaugaaaugugcugaccuuccaugaaccaccugacaaauccacaugagucaggccugcagcagcucagaaagcaccugcugcccacuggcuucacuugguuuucugcuucauacagugggaaucauauagaaaggaauuuaaaaaaaaaaaaaagacuuguaauuuuuagagcauuuuagguucacagcaaaauggaucggcagagaguuccuguagacucugagcaccucccaccacacagcuuccccugaccccgucagugccccccuccacuguggugcacgagcugcagucagccgccccacaucgacucaucaggaucacgcaggcucuguccacacacccgggcucaggaucacgcaggcucuguccacacacccgggcucagggucacgcaggcuguauccgcacaccugggcucagggucacgcaggcuguauccacacacccgggcucaggaucacacggccuccaccucacaccugggcucaggaucacgcagccuguauccacacacccgggcucagggucacacaggcuguauccgcacaccugggcucaggaucacgcaggcuguauccacacacccgggcucaggaucacacaggcuguauccacacacccgggcucagggucacgcaggcuguauccacacacccgggcucaggaucacgcaggcuguauccacacacccgggcucaggaucacacggccuccaccugcacaccugggcucaggaucacgcagccuguauccacacacccgggcucagggucacgcaggcuguauccacacaccugggcucagggucacgcaggcuguauccgcacaccugggcucagggucacgcaggcuguauccacacaccugggcucagggucacgcaggcuguauccacacacccgggcucagggucacgcaggcucuguccacacaccugggcucagggucacgcaggcucuguccacacaccugggcucagggucacgcaggcuguauccgcacaccugggcucagggucacgugggcuguauccacacacccgggcucagggucaugcagccuccaccugcacaccugggcucaagauuaugcagccuccaccugcacacccaggcucagggucacgugggcuauauccgcacacccgggcucagggucacgcgggcuguauccgcacacccggacucaggaucacgcagccuucaccgcacagccgggcucaggaucaugcagccuccaccugcacacgcaggcucaggaucacacagccuccaccugcacacgcgggcucaggaucaugcagccuccaccugcgcacgcgggcucaggaucauucaggcuguaucugcacaccugggcucaggaucacgcagcuuccaccacacacccaggcucacgcugggcggugcguguucuauggguuuagaugaaugcguagugacggguaaccacuguuacaguuucauacagagugcuuucagaguccuaaagauccccugagcuccacccauucaucccuccuuccccagccuccagcaaccauugaucuuuucaccggcgcuuggucauguggucguagagcuggaguugcacacugugcauccuuucucugugcagccugucacucagccaugggcauuuaacuguccuccaggucucugcacagccuguggccucuuucucuuuaguggugaguaauauuccaccgccuaggugcgccacaguugauuuauccuuucaccugcuugcugaagggaaucugggcuugggcgauuaugagugaagcugcuguaaacgucacgugcagguuuuucugagugauugcugggugguguggugagaguaugcugaguuuuguaagaaacugccaaacccuuuuccaaagcaccugagccauuuugugcucccagcagcaaggaaggagagcuccuguggcucuagucguccgcaucuggcuugccagugucugggcuggagccguucuagaacgugcuguuuuggagcguguaaguaguuuauucuuuuauugcaauguaguauuucaugggaugaauagaccacaguuuaucuccuuuuccuguugauggacgucuaggguguuuccauucuuggcugugcacaggaagcugcugugcguguucuugcaccugguccuucgguggacacaggugcccccuccgcuugggaguuuaccugcgaaugggugucuggguccugaggucugggugugcucaucauuagauagggccacaggguuuucuguagugcuuguaccaguucauguucccaccaggaagcaguguaggagagucccaguggcuccgcagccuuguucacauguggcaucaucagccuuuccaguuguagucuuucugguagguguguagcacacucgcugcggcauuaauucgcuuucccuggugaguaauuauggccacaaccuuugcucaugcuucuuggcuguugggacguccuuucugugugaagugccuauuggcgucuuuugugcuuuuuaaaaacugaguugucuuuuucuuacagauuuguagaguucuuuauauauucuggauucgaguccuuuguuggauauacauguuucgaauccuccucccacgucuguagcuugucucacucucuuaauguugucuuuugacgaacagaaacuucugaauuuuuuuuuuugagacugggucucacucacucugugguccgggcuggagugcaguggugcagucgaugcuccuugcagccucaaccucccagacuaaagccgcccucucacuucagccucccgaguaguugggaucacguguacaugccaccacauccacucauuuuuaauuuuuuucuuugacauggagucucacucuuuugccagacuggagugcaguggcgcgaucucggcucacugcagccucugccucaugggugcaagcgauucuccugccuuagccucccgaguagcugggauuacaggugugcaccaccaugcccggcuaauauuuguacuuuuuaguagagacgggguuucaccauguuggucaggauggucucgaucucuugaccucgugaucugcccgccucggccucccaaaguguugggauuaccggcaugagccacugcgcacggccaauucuuuuuuuuuuuuaaauagagaugggggucucaccauguuggccagguuggucuucaacuccugggcuccagugauccucccaccucagccucccaaagugcugggaugacaggugugagccacugcacccugccagaaauuucuuaauuauaaugaagucccaguauaucaguuuuuaugguuagggcuguuugugacuuguucaagaaauucuuaucuacuccaaggucugaagauacucuuguguuuuccucuggaagcuuuauugcuuuauacuuuacauguaaguggugauaugccucaaaucuuuuuuuuuuuuuuuggagacagggucucgcucucuugcugcccaggcuggacugcaguggcaggaucauggcucacugcagccucaaccuuccaagcucaagcaguccuccuaccuuggcugggccuacaggcuugcaccaccacaccuggcugauuauuuuagcaguuggaucucacuauguugcccaggcuggucuugaacuucugggcucaagugaucuaccugcuucagccucccgaagugcugggauuacuacaggcaugagccacggcacacagccugaguuuacuuuuagaauucauuuguuggaaggaagucuaaggagacucgcaggcuauggcuagcuaauuaguaguugguuucuaugugaauaucuguuuauuaauaacauauuuggccaggcacaguggcucaugcuuguaucccagcacuuugggaggcggagauggguggaucacaaggucaggaguucgagaccauccuggccaacagugugaaacccugucuguacuaaaaauacaaaaaauuagcugggugcaguggcaugugccuguagucccagcuacucaagaggcugaggcaggagaaucacuugaacccgggaagcagagguugcagugagcugagaucgcaccacugcacucuagccugggugacagagcgagacuccaucucaaaaaagagaaagaagaugguaaaaaauaacuuacugcagucaucauaagcccccauuuuaguccuuuugggcugcuguaacagaacaccauagaccagaaaggcaaaacagcaggaauguguuucucacacuuuuggagcuggaaaguuugagcuggagaugggggagacaguugccuccuccccagcucucuagugagggccgccucucagcuccuucucacuguggccuccuccccagcucucuagugagggccgccucucagcuccuucucacuguggccuccuccccagcucucuagugagggcccccucucagcuccuucucacuguggccuccuccccagcucucuagugagggccgccucucggcuccuucucacuguggccuccuccccagcucucuagugagggcccccucucagcuccuucucacuguggccuccuccccagcucucuagugagggccgccucucggcuccuucucacuguggccuccuccccagcucucuagugagggcccccucucagcuccuucucacuguggccuccuccccagcucucuagugagggcccccucucagcuccuucucacuguggccuccuccccagcucccuagugagggcccccucucggcuccuucucacuguggccuccuccccagcucucuagugagggccgccucucggcuccuucucacuguggccuccuccccagcucucuagugagggccgccucucggcuccuucucacuguggccuccuccccagcucucuagugagggcccccucucagcuccuucucacuguggccuccuccccagcucccuagugagggcccccucucggcuccuucucacuguggccuccuccccagcucucuagugagggccgccucucggcuccuucucacuguggccuccuccccagcucucuagugagggccgccucucggcuccuucucacuguggccuccuccccagcucucuagugagggccgccucucagcuccuucucacuguggccuccuccccagcucucuagugagggccgccucucggcuccuucucacuguggccuccuccccagcucucuagugagggccgccucucagcuccuucucacuguggccuccuccccagcucucuagugagggcccccucucggcuccuucucacuguggccuccuccccagcucucuagugagggccgccucucggcuccuucucacuguggccuccuccccagcucucuagugagggcccccucucggcuccuucucacuguggccuccuccccagcucucuagugagggccgccucucggcuccuucucacuguggccuccuccccagcucucuagugagggcccccucucagcuccuucucacuguggccuccuccccagcucucuagugagggccgccucucggcuccuucucacuguggccuccuccccagcucucuagugagggccgccucucggcuccuucucacuguggccuccuccccagcucucuagugagggcccccucucggcuccuucucacuguggccuccuccccagcucucuagugagggccgccucucggcuccuucucacuguggccuccuccccagcucucuagugagggccgccucucggcuccuucucacuguggccuccuccccagcucucuagugagggcccccucucagcuccuucucacuguggccuccuccccagcucucuagugagggccgccucucagcuccuucucacuguggccuccuccccagcucucuagugagggcccccucucagcuccuucucacuguggccuccuccccagcucucuagugagggccgccucucagcuccuucucacuguggccucacgugguagaagagcugggcuaguucucugggguccgguuuuuaagggcacugagcucaucauuagugcucugccuccugaccuagucucccgcaaaggcccugcaucuuaauaccauccccguaggggauaggauuucaacauaggaauuuuaggagucagacauucugaccauagcagcccugcaugcugggaacacgagcuggugccuguggggucggggcuugggaucgagucccagccucaaguguguggccucagagaguaccucucucuuaccuuuuauuacagaauuuucaaacauacagcagagagcugguagguaaggagccguagcuucagcggguccccugucagcugacucuguuucccucugggccuugcugggccgcggggacggucugugcuggugugucuggcuggugcugcacaugugcagguggcagcuggcacgaugcccuuucuguccauucuuuuggggucuuggcuuggcccaggccucagcucuggggacagugaccagccuuccacgucagcucagcuggacugcaggccucagagcuguaugagcucuaggcagguggccuuaggugcucaagguggcagggccacagccgggcugggggcuccaugugaugcugcugacugccaggggccuggcagugugaggcuugaccuggaccugccagacuguguacccuggccaccggcuuccuugggaugcaggcucagcagcugcccaccucuggcugcuggucaucauuagugaaguuuggcgugagcaaaacaucagcccucacuuucuccagcucaugugcccuuaucaaauaaaucugggaggucaguuuuugacuuuauauggggauggaggccgccucagguagucuuugcaggaggacuguggguuugggugccagaggaugcagugggaacuggaaucuccauggcggcagcauuccucugcaucgagccgugacccaccacacauguccucuggguaccccauggggcuaauugccuggagcaaggacucugccugcccacgacgcccacugugcagacagaagugggggcaguaaaguuggcucaggugcuccccacacagccugugcucugcagacagaagugggggcagugagguuggcccaggugcuccccacacagccugugcucugcagacagaguggggcagugagguuggccuguacucugcauugacauuuguuucccaagguuccuccugccugcagggcagcuuugccauuucccuccugaugccaucauguggcccgcagcuuugggagggucuugcuccagggaggcgcgugugcucggauguugccguccuggccaccuccagcaccucgcagccccuaggagggcgcaguggccuccggucugcugggcaugcccuuaccauggugaagggguggccugccccuccacaccuguggguauaucucgucaggugggacgagagacugagaaaagaaaugacacagagacaaaguauagagaaagaacaguggggccaggggaccggcacucagcauaccaaggaccugcaccggcaccggucucugaguucccucaguuuuuauugauuauuauuuucacuaucucagcaagaagaaugcggcaggagagcagggugauaguggggagaaggucagcaagaaaacaugugaaccaaauaaucugugucauaauuaaguucaagggaagguacuaugccuggaugugcacauaggccagauuuauguuucucuccgcccaaacaucucagcggaguaaagaauaacaaggcaguauugcuaccaacgugucuaaucucccgccauagggcgguuuuucuccuaucucagaauugaacaaguguacaaucggguuuuauaucgagacauucaguucccaggggcaggcaggagacagaggccuuccuguaucucaacugcaagaggccuuccucuuuuaccaauccaccucagcacagacccuucacgggugucgggcugggggacggucaggucuuucucaucccacgaggccauauuucagacuaucacauggggagaaaccguggacaauacccggcuuuccagggcagaggucccugcagcuuuccgcaguguauugugccccugguucaucgagacuggagaauggcgaugacuuuuaccaagcauacugccugugaacacuuuguuaacaaggcacguccugcacagcccuagaucccugaaaccuugauuccauacagcacagguuucugugagcuccagguuggggcaaaguggcuggggcagaguuacagauuaacaccucagggcaaagcaguuguucagggcacaggucaaaauggagucucuuaugucuucccuuucugcauagacacaguaacagucugaccucucuuccuuuucccuacaccauggcccucccucugggcaggugcaggggauggcgcuagccuggcuuuuucucaggccggguggcuggcucuuagaggagaggcuggcgggcgcagggcugagcagaaugggcccugcugagaagggacgggugggcugacccagacucugugcgguuggggaaggcgguggcgcuggggcauguggcuguaggaaaaggggcauucccacuguagcccagggcagucaggggcauagcaccugccagccagcccaaaccaagcccuugccagacacgccgcaccucagagcccuggagagaggcacauucagccacaccgcacacgccacucagagccuaaagaagggaaacagguagaacaggaucucauggcacauggagaucacagaaaauucacauuucaguguccuuaaauaaaaagugauuggaacccacauauaaaaagugagcucagaaacuuacaaggaaaagcacaaaucuauauucuuaaaguugcugcuguggccgugugauacuuuucauguucugugggaacauuuggcuaagagcugccucgugcuguguccuagggaggcgccacauccaccaccuggggaaccagcugcagcugaaccagcacugccuggacaccgccuucaacuucuucaagauggccgugagcaggcaccugacccgcggccggaagauggcccacgugauugcugccugccucuaccuggucugccguacggagggcacgccgcguauccuuugguuugagagccucccagagggccccaucuugaugcuuaguuggcuccccucgaauauugggacuugguaguugcaguaacuugguguuugucuuuaauagaaaaacaccuuacuggaagaacuguuucaguugauccagggcuuucugaauuuggggucuccuuuuacuggaucgaagaacuggggagcugggcaccugccuuccucgcacagcccuugggcaugcagagcgaggguucugucggugccugagaaucaugcccuggauucuccccacuuguggaccuacugcgccuugggugcugucuccacguccccugugguucaggccgcccucuggccugagcagguggggugcuguugcugagugggcugcagccaggcguacaccgagugccugcagcuguggacaccgugacugugggcgauggguggggaggccgccgacccucagcggugugcagcucggccuugugcguggauaccgugacugcaggccguggguggggaggccgccgacccucagcggugugcagcuuggccuuguguguggacaccgugaccgcaggcggugggcgaggaggcccccgacccucagcggugugcagcuuggccuugugcguggacaccgugacugcaggcggugggcggggaggccgccgacccucagcggugugcagcuuggccuugugcguggacaccgugacugcaggcggugggcggggaggccgccgacccucagcggugugcagcuuggccuugugcguggacaccgugacugcaggcggugggcggggaggccgccgacccucagcggugugcagcuuggccuugugcguggacaccgugacugcaggcggugggcggggaggcugccgacccucagcggugugcagcuuggccuugcguggagauccagugucugguguucucuugcacuggucucugugcaucugguccugugcccacugcugccaucugcagacacacacaugggucaggagcugccuucggccucuugacagggagcccagagccuuccagccuccucugcucugugcugugcuguccacaccugcugugcaccugcaucuuuucccugcucucuggggacuccccgcuuccugguccacacccuccucaucuugugaggugccuccugcaauggcucccugggagagggaccuuuuccgagcugcgccccucugaagguggucccccucccugcccugugucuggugggcguggcgugcccggccacaugucugccucccagccugcgccccugccgucgccuugccuccagcauucucacugggcaguucuguggcccucuggcuccuggcccuugcugugcagcugcggggcuucagcuccuugccucuaaucuccacguucagaaaucucacggcagugugagcccaucaggccuuugcucucugacagcuuccuguccugagcuucuguugaauucgucguuagaugugucucccuucuucucuguuacucugccugccacacugaacccauguguuaucucauccuuuuuugcacguggcuaucuuuuugcuuugggacagcaccugaacuuuagcuuccagcaggcuguuucauuucuuucauguuuuucaucucuaagagcucugggucuuuuccgaaucuuuuuuauaaucucccgucuuccugaguguggcaucuucucaccuugagcucuuuucugucuuggucuguuuuucugguuggucccccucgagggguguccugggugccaggugauccugguggccugcuucucuuuugaguggggugcagggagggcuccuggagaugacgagcugguagccugcugacggugccucuggccaggcaacccucaguaucaggaucuuucauuaaaauguuacuuuuuuuuuuuuuuuccagacagggucuugcucugucacccaggcuggagugcagugguaguaucucagcuuacugcaaccucugccucccagguucaagcaauucuugugccuuagccucucgaguagcugggauuacaggugugcaccaccauaccuggcuaauuuuuuuguauuuuuaguagagaugggguuuccccauguuggccaggcuggucucaaacuccuggccucaagugauccacccgcccuggccucccaaagugcugggauuauaggcaugagccacugcauccaacccugaaaauguccuuuuaacauuuugaaauuugggcugggcaugguggcucacgccuguaaucccagcacuuugggaggccuaggugggcggaucacgaggucaggagaucgagaccauccugucuaacaccaugaaaccccgucuguacuaaaaauacaaaaaaaauuagccgggcgugguggcaggcuccuguagucccagcuacucgggaggcugaggcaggagaauggcgggaacccgggaggcggagcuugcagugagccgagaucgcgccacugcacuccagccugggcuacagagugagacuccgucucaaaaaaaaaaaaaaaaaguccuuucaacauuuugaaauuugucauuucugcguaaaaguguuuaaagcacacgugugccuuuagggacagggaugaugcagagugcccaggcagcccacugcagggcgagagacagagcccacgcccgcgucccugcccgccccgccugcugucugcuugccccggcuccacccuggggucccacugagaggccugcuccgauccugcucucuuagaagcagaccaagguccugagcgagaagcugagcagagcccagggucagcccauggcccugccucccuuguguuuguaggagcuguguggggacugcuguggagcagggccuagggugcaggccggcacugggaccccagcgucagcaaggugggguggaaccacguccaugcugcugccucacugggccuccugugggggggacagaugcccugggacaugggccuucauggggugaugacaggcaggacggagagcaguccuguggcacugccggggcugccucugagucuggcaggaccaccuuuagccacaaaguucccacacgcuccagcgauccuccuacuaagugugugcccaagggaaaagaguaccuguguccccaccgaggcucacgcacagugcucacaguggcagcauccaggaagccaccccgugucccccacgcauucuaaaauuagauccugguggugguugcucagcucuggggauuuacgaaaacccacugcccggugcacugugaacaggcagguuuguggcacaaacuuguaccuuauaaagcugcuaaggacaagacagcuuggaacaggacugugcucacgggaggccgcacucuauccccucuggcugcugguggccugguggggcucccuucagcauccucagaggaugcuucgggcuggucucggguagcuguagcccucacuucccagcccaccccugcuuugccggcacuuuagagggaagugggucaggccagguguagcaugucccgcucugcccucccuucagguugcgggcagcaccgugcccuaggccugccagccagagcccccagacccauccuggacacgucuccgucucucaccgcccuccuuguuuucuccugccccugugccuucucccucccugcugaccugcauuggcucuggccacuguccucgccuccugcagccccagcuggcuggcugggcucaugugcugccucaguuuccucaauagcuccacccacuucccuuccacagaaaauccacccaggagagggugugugcagccaggcucucuucuccgagacagggcugcuuggcccagcccugcugccugcacagcucccgucaccuucuggacucgccaccuuuagccagggcgcaacagcacccaccaccccaccuccacccugccgucagcaggacguggaggguccugugcagugagcuuacguuguggggugcauggcccccaccccaggagaggccccccaggauccuccuaucguaucguccagcccaugggugggaccagugcccugagcccagggcuggauacaagaaauccucucucagaaggaacaagggcuugauuuaagaacauccaagcuuauuccuccuucugcccacccuucauuguugcccgauccucagguguguccacuaucaccccgaaagugccgggggcugugcacacacaccuccucucuuggccccguagccugguggcugacacagccagucccggauuccuggaggaggaacggggugcugcugagucccacugagucuggcaaggcccggcugacccuaggccugagucugcuccuggcucccagcccagggaggcugcgugggcagcagggcugagacacgggaccuggacaugccgggcagagacucagcuggaaugagcaccucugccauugucgagcagguaguuuguggccagugugcuuuuccuggcugugugucucgacuuguuauugcagcuuuugcccacagcugguuugugggucuuugacauuuguuccuguccagccaggcugcccuaggccugcaugugagagggcaucuugggauggugacaggcuggugagcccuagagggcgucagagcccuggggccagcacuguggauggugccaucaccuguccccacguaggucugcaaagagcaugcccagcuuccauggccugccagccucagccuccauggcgugccuggccacgcgugggagcaaggccucugccgccagccgccacacucccuucagacccagcuccucucucaggcugcagaaccguccguucaggucagcaggggccaugugcauucagcuuauuccauucuggggucugggaugggcuuucagagcccacacuucucugccccccuguucuggccagcaccuccuucugccaccaggcccccuuguuccugcuccucucccucugcugccuucucaaggacagggcauuuauaacaguuuaaguggucagaagaagguauuaggauggcugaugagggaaucaaauggugcacacaucauuaggcaugaagacguuggcauuucaggucaggcacaguggcucacgccuguaaaucccaucacuuugggaggcccaggcaggaggauugcuugaguccaggaguuugagaccagcuugggcaacauggugaaaccccgucucuacaaaagaaaaagaaaacaaaaaaaaaaauccagcuggugguguguaccuguggucucaccuacuggggaggcugaggugggaggaucgcuugaacccaggaggucgaggcugcagugagccaugaucgcaccacuacacuccagccuaggcaauagagugagccccgucucaaaaaaaaaaaaaaguugccauuucagacuuccgaaaggcugaccuggaaacaccggcacacccagcgugggcccaugugggccccuugucgguggugucuuguugcuggcguagcagagguuuagcugaguuuuguauguugacauuauuaauacaucauuccuaccaaauucaauugucgaucuuacuguuugaguuuuggagucucuccuuuaaugcacacaacugugucugcugcucauaaugccaguucugcuucuuucuuuucauuuuuuucaugagacaggaucucacuugaucacccaggcuggagugcaguggcgcagucuuggcucacugcagcuucugccucccaggcucaagcgauccucccaccucagccucccguguagcuggacuacaggcauacaccaccaccccuggcuaauuuuuguacuuuuuguggcgacgggguuuugcuguauuguccaagcuggucucaaacuucugagcucaagugaucugccucccucagucucccaaagugcugggauucuaggugugaaccccccgcccagccuugguucuuccuuucuaacccacacaccucucaucuguuuguccugccuuuuguaugccgaggacucagcaugguccuggggagggagaugugccuggcucucuccuguccugggagggguguuuucugcccuucgcucuauguaucugcgguagacuuuuguguauaggacucuuuaucagcuugaggauguuaccuugcuuucuaauuuuccaagaguuuuugucaugaaaaauacugaauuuuaucaaacaccaauguauuuauugguaugauuuuuucauguacauuuuccccuuaaucuguuaccuaacguaaauaacacugauuaauuuuuuaaaauuuuuuagaaacagggucuugcucuguucucccaggcuguaccacuguggcaccacccuagcucguugcaaccuccaacucccuggcucaggcgacucucucgccucagcaucccgaguagccgggaccauaggugcacuagagauggggucucacuguauugcccaggcuggccucaaacuccuggguuccaguuaucuucucaucuuggacucccaaaguguugggauuacaggugugagcuauuguaucuggccuguuuuuucuaacauaagcacucgaggcuauaaauuucucucuaggugaguuucguuacaucacacgguuuuuuguuuguuuuguuuuuuuuugagacagagucucacugccucacccaggcuggagugcaguggugccaucucggcucacugcaaccucugcccucuggguucaagugauucuccugccucagccucccgaguagcugggauuacaggugcaugccaccaugcccaccuaauuuuuuuuuuuuuuuuuuuuugagagggagucuugcucugucgcccaggcuggagugcaguggcaugaucucagcucacuacaagcucugccucgcggguucacaccauucucccgccucagcuucccgaguagcugggaauacaggugcccgccaccacaccuggcuaauuuuguuuuugaauuuuuaguagagaagggguuucacuguguuagccaggauggucucaaucuccugaccucgugauccauccgccucggccucccaauacugcugggauuacaggugugagccacuaugccuggcccaugcccagcuaauuuuuguauuuuuaguagagagggguuucaccauguuggccaggcuggucucaaacuccugacaucaggugaucugcccaccuuagccucccaaagugcugggauuacaggcgugaaccacugcacccggcccacuaccugcuuuuaagaaauauuuuuguguuuggauuuggcaguuugacucugauguaccuagaugugguuuucuuuguguuuauccagauuauuuuuuguagaaguucaaggauuugugacuuggcugggugugguaguuuauggguguaaucccagcgcuuugggaggcugagguggguggaucacuugaggccaggaguuuaggaccagccuaggcuaauaaaagaaauuagccaggugugguggugcacaccuguagucccagcuacucaggaggcugaggcaggaggaucacuuaagcccaggggucaaggcugcagugagcugugaugacaucagugcaucagugcauuccagccugggcgacagagugagacccugucucuaaaaaaacaaacaaacaaaaaaaaaacaaaaaaaaggauaaguagaacuuaugacuugaugucuuuugucuacguuggagacaucuuggguaguaucuuuucaaauaaaguuucugcuccacucucucuuccuguucugggacuccauauauuagccuuucucucuuuugcucauccuuucuuuugcugugucuaaucagguguugaacccaucuacuaacuucuuaauuuuuuuuuuaagagauggaauaucgcuguguugcccaggcuggagugcaguggugcagucacagcucacugcagccuugaccucccaggcucgagcaauccucucaccucagccuccauaguaguugggacuacagguaugcgccaccacacccacucaauuuuuuuuuuuuuuuuuuuuuuuuugagauggagucucauucugucacccaggcuggaguucaguggcacaaucucggcucacugcaugcucugccucccggguucaugccauucuccugccucagcuucccgaguagcugggacuacaggcacccgccaccaugcccggcuaauuuuuuuuuguauuuuuaguagagacgguguuucacuguguuagccaggauggucccgauauccugaccucgugauccgcccaccucggccucccaaagugcugggauuauaggugugagcaaucgcgccuggccaucaauuuuuuauagagaugaggucucacuguguugcccaggcuggucuugaacuccugggcucuuuauuuuuuguagagaauggugucuugcuauguugcccagccuggucuugaacuccugggcagaagcuauucuccugccuuggccucccaacgugcuaggauuauagaugugagccaucacuaagacuccuuuuauuagaguccaguucuuugguaagauucuucauuucuucauaguuaggugaaagucauugauaagccaaauaguugaaucauuugugguucuguuuuuauuaucuugauuuucuuuuuguuuuuguuccuuuggucuugucuuuugucaugcuugguaauuuuucauugaaucgcuggaauauuaggucuaaaauauuacagagaugauggauacuuuuccauccagagggaauuuaacuuuucuuuuuuuuuuuuuuugagacagagucucacucuguugcccaggcuggaaugcaguggcaccaucucugcucacugcaagcuccgccucccagguucaugccauucuccugccucagucucccaaguagcugggacuauaggugcccgccaccacauccggcugauuuuuuguauuuuuaguagagacaggguuucgccguguuagccaggauggucucgaucuccugaccucgugguccgcccaucucacccuuccaaaguguugggauuacaggcgugagccaucgcgcccggccgggaauuuaacuuuucuugagcaagcagagagcacgcagguagcucacucugauccaguugcugcugguccgucuugguucccggcugaaggaucguggcaggacccaggugucccuuccuggcaccucgggacugcagaacuuccugcucggcucuuuugccuuucagagcugacuucugggcuuggcgggccucagccuggugccuguggcuccaggggcggcagcugccguaaagggacuaagugcacugugcccugcucgcuuguugaaguugcuuccucuucucuuggcagcuuggccccucgugucuggcuggcucggaagccacugaacuguaaacucuaucuucccuugccaagcgagacugugagcacuaggcuccuacuuuuuuuuuuuuuuuuuuuuugauggagucuuacucuguugcccaggcuggagugcaguggugccaucucggcucacugcaaccucugccucccggguucaagcgauucuccugccucagccucccgaguagcugggauuauaggugcccaccaccaugccuggcuaacuuguauuuuuaguagagauaggguuucaccauauuggccaggcuggucucggacucuugacguugucaucugcccgccucggccucccaaaguguugggauuacaggcgugagccaccguguccagccacuuuuuuuuuuuuuaaauggagauggggucuugcuauguuguccaggcuggucuugaacuccuguccucaggcaauccuggccuggcacugccagacuaugacagcuuauuagaauuggcgagaauuggaaggaggcccgagcugagacacugcaccuuacacucgugccacucagcuccuccuggggccauccaugugccugguugcaugugugugcuugaaagccaggggcugggagcgucaggugacugccuggauagcagcugcauuauccgugagaccaccucaguguggcugggacagagccaggcucccagcucugugggaggcucagucuucagagcagggaucuuugagaaggcaccuggguacccuugaacuucacagaggccaugcaugaugacagcggugaggugcuagauuauucaggguguacugcacacaggagcccaccgugggguguggcagccagcaguggcucagggauuuagucacugugcaggggaugggcaaggcccagcaaugacccacuggcucuucccuggaggucagagguaucuggacaaagggcagccagcaggucuccuaccccgcaucagucauucagggacucccagagcaccugcucugugccacaccuccaggcggaggagcaggguggucucugggaaguucgggagggcagggcugcucaugaccuaggcccugggucuugauggguccugcucuuggggugcugagggcauccgagcucuggggugagugaccccauuccaagcuaggauccgucauagccccguccaggcaugugcggggccugaggaugcccagucugccugccgggcuccugugugggugcuuggucggccgcugagugcuguaugcugagugcugccagggccuugcccuugguggguuggggcugggcacuacugcucuacacggagcuucggccgggccguguguucccgugccaggugguguuggcugccggugaggagcacucagagcagggggggccugcagaaggggaguggcacuggguaggggcagugagccgugggccggugcagugcugggcaucauucuccagaagguguggguuucgcuccuugguccucacgccgugugggcgccgcagucccccucuccagucccauggggccgggaaugcugguguccgcucaggguggggcccugccggccccugcacugcuggcuguuguggacacagcccuuucuguggggcucuauauacaagagcacuuucccucgcuucucucuuuggguauccaguaagagcauuuguaugugaggcuguugagagaaauuucuuguuuuuuuaaguuuuaguucugccuuauguaaaucucuguaaacuuuuccauguaaggaaagugugucugagucaggacccaucugcaguuuuucucccugcaagcaucgugcagccagccagggugugggcagccucaguuuccccauccucuucacaguggaguggccccucgcuguguuguccacagcugugguggggaagccugguugguuccuggagccgggacaguuugauggcacagcaguggggugcagggcugcaccgucaugacuggaccauuucugggccuugucaucugcugaugggagccucgcgugggccucugccgcacucaggaaugucuggcgcccuuugagggcauugugucaccugcccucuauugugcucccgcgucucuccuuugacuggcacucagcugcaccgagcagaagaccacccggcacagcguggcaggggccagaagggaggcagaaagaggccccagcuggcagaauccaggcuuucgcacccugggggccgcagacagggccucuucucugcagacuuuuuucugauucccagauggucagaagcagcugcucagcaaaagggaggggcugcugggaggacacagguaccagccaugcuggacacaggagaaccuccagagcccugggagcucauuagcugggggaccuguaggcugggccccaaaggcauuaguaggcccucccgggauuggccagagggaaugugauauccucacaagggaagcacauaauugagcuuccaucgucuggaaacuucccugaaagcgccugauagagccaggugaaugcggaucaagugccaggugauuuucauuucaaggaaagcaguaauucuaacuucguuaaauguuuaauuugaagcuccuuuuaaaaauguacacacuuaucccauuguuuuauuaagaaaauuuucuguggagcuugguggcuuaugucuguaaucccagcacuuugggaggcugaggugagcagaucaccugaggucaggaguuugagaccagcucggccaacauggugaaaccccaucucuacuaaaaauacaaaaaaaaauuagccaggcaugguggugcaugccuguaguccaagcuacuugggaggcugaggcaggagaaucgcuugaaccugguaggcagagguuguagugauccaagauuguaccauugcacuccagccugggcgacagggcaagacuucaucucgggaaaaaaaaaaaauucgaacaccugcaaaguugaagugaauuguggaguccccucgcucacaccugugguccgcuccccaaagcuaugcugcccucaccaucuuauuuuuuggcacauuucaaggcaaguugcagacgucuguguacugcacacaguccuucagcaggcagaccaucagcucaaugggggugagcaucguuccugggucuuuuucuccucugaagguaaaguuggcuuaaagugagaugcacaggcccuaauugcuccaucuggagaguucugacaaacggucacccgucagcccagagcagggcucuguggacagaccucaugccccuuccaacagucccagccccgcaaaaggcaaccgcuguuuccauuuccuuccacuacagaccaguugugccuguucuagaaugcccuauaaauggaaucauaugaucugugcccugucacuucacaugcuuuuuuuuuuggugacagaauguagcucugucgcccaggcugagugcaguaugguuccaucucagcuuacugcaaccucugucuccuggguucaagcgauucuaaugccuuagccucucaaguaguugggacuacaggggcacgccaccauguccagcucaucuuuuguauuuuuaguagagacaggguuuugcuguguaggccaggcuggucucaaacuccuggccucaagugacugcccgccuuggccucccaaggugcugggauuacaggcgugagccccguguccgguggacaugguuuugagaggcgcccaugguguuuuguauggugagugguauugcugugugaauaccagccagaguauucuuguauuaauggacaccuggacugcuccccguuuuuggcuguucugaaugaagcugcuaugaacauuuuucuacaaguuuuuuuguggacauauuucuuuuuauuuuuagagacagagucucacucuguggccccagcucagugcaguggugcaaucacagcucacugcaaccucgaccucuugggugcaagcaauccuccugccuuagccuucugaguagcugggacaauaaguguuugucaccauacccggcuaauuuuuggauuuuuuuguagaaacagggucucacuguguugcccaggccggucuugaacuccugggcucuggugaucugcuggccucagccuccuaaagugcugggauuaugggugugagccacugcaccuggcugacaucuguuuuuauuucucuuggguaaauaccuaggaguggaauaggugggucagagguguguguuuagcuuuguaagaaacuuccaggccuuuucccaaggugguuguaccacuucacgcuuccaucagcagcaugggugagcugugcuugccccacauccucgccggcauucagugacgucgcgggcucguggcauugucacaguuuuguuugcauuucugaugauuaaugcaguugaguucuuuuucaugugcuuguuggcuauuuuuuuuugucuucaugaagcuucuguugaauuguuuugccuuuuuuuauuuuggccuuuauucuuuuucuuauuuaaauagaguucuuuuuuuugagacugagucucgcucuguugcccaggcuggagugcaguggugcgauauuugcuuacugcaacuucugcuuccuggguucaagcaauucucccaccucagccucccaaguagcugggauuacaggugcccgccaccacccccuggguaauuuuuguauuuuuaguagagacgggguuucaccauguuggccaggcuggucucaaacuccugaccucaggugauccucccaccucggccucccaaaguguugggauuacaggcgugagccacugcgccuggccuuagaguucauuucuuuuuuuuuuuuugagacggagucucgcucugucgcccaggcuggagugcgguggcgccaucucggcucacugcaagcuccgccuucuggguucacgccauucuccugccucagccucccaaguagcugggacuacaggugcccgccaacacgcccggcuaauuuuuuuguauuuuuaguagagacgggguuucaccauguuagccaggauggucucgaucuccugaccuugugauccacccaccucggccucccgaagugcugggauuacaggcgugagucaccgcguccagcccaguagaguuuauuucuuagagcagucuuaguuuacagaaaaauuguguagaaaguacagaguucccauacacccccuucaauccccaauuucccuauguuauuaacaucuuguguuagcugguccauuuguuaugguugaugagcccgucuugccaaguuguugauaagaaaaguccacaguucacauugagguucacucuuggggcugugccuucuauggguuuucacaaauaugcaauaugugaacccaccagugcggaguggugcagagcugcagcguccuggaacccuccucucggcccacccacccugccuuuccccagcccuugguggccacugaccuaaugcugucuccauaguuuugccuuuuccggaagguguaugcuuggagucacacaggguguagccuucuggccucguucacuuuucccguugguguguguuggcugucacgggcguuuccccagguaguucuuacugcuuuccuuugguuuccuuugaugucacuggccccaccccugccgccggucuucucauagugccucuugugaggcuguuggcugugcugcagucgguccugcccguugucucggcccucugggacugccugccuucagaugcaccuuuguucacgggccucaccgcucacgucccagccguccuggggguucugcucugugucggaaugccccuguacccagcccuggcaccuucuuagggugggaggccuugcuguucugcauggaguugcaagagaggucaggggccuccagcccagggcguggaugagugggcuggcguccuaaccaucugauugcuugcgagguucuugcgugguggggcuuugcugcucuggucccggggaucuuccuuuggaccccugcucuggacuccugauccagcuccaggagguguccuuagugacuucucgaagcuacagugggcccaugggagaugugcacuucagcugucuggcagaguguauuaaccagugacuuguguuugauaacuuauguauccaugugaguuuugaaucacuuaggacacauucuugguccuguuuguucaucugagcgaagacagguccugugcgggguccccacaccugucucucgagcgcagcccccaguggcgccugcaggcucaccacucaccaagggggccccaggucuaguuuucugucucucgggaggacugccugccugacgccugauaggugcucagcaagugcccuugggauggagcaugagugccacugucucuucugugcugugugugggcagcagauccaccauauggugggcaccugacugggcaggcgggugugugggggugcacgcuuucuccaggaucagauggaagcccccaccguuucugguucccccgacccggcuccagguuccuugcagucccuuguccugguacuggguucacagaagucucacuugugccuggggcugggagguucuggugaggccugagcgugccgcgccucgcuuccauaccaccuuuccuuccugaucaaagguggagcuuauauuuggaggggcgacuccagcucccugcaggugcaguccugcgguccugcccauuugaaggugggcgaguaaccugagcuugcagccacucgacaggauccuugacuccugcugcagacaugcuccuggaccucagcgaccugcuccagguagacagccuccguccugcaucuuuccccaccugggguugugaccuggggguugugaccaggguugugaccgggguguaccccaggugccuccacgcaucucaguggccggucugugcugccugcccagucaggaaguuuuggucuguaggaugaggggccuucaugacaugggggucacaguccgagacuugugggagugugggucuccauggcaggagggcaccugccaaugcugggcacgguuggguguuagcuaggccugggugaacagugaacuuuuguccuacacaaaggagauuauuuucaauuaaaaaauuuuuuugugaguaccuaguuugguauaggagauuauuucuuuugaccuugcauuuuauuuauuuauuuauuuaugagauggagucucgcucugucacccaggcuggagugcaguggcgugaucucagcuuacugcaaccucugccuccugggcucaagcaauccucccaccucagccucccaaguagcugggaccacaggugcccaccaccaugcucggcuauuuuguauuuuuaguagagacggggucuugcuauguugcccaggcugcucuugaacuccugagcucaagcaacccucccaccaaggccucccuaaguacuggggucacaggcaugaacaaccauaccuggccucuugcaugcauuuuaaauuguagaaaaaucuuauauuacagucuguuuggagacacucacuuucuggguaccacagaaagcacuuucaguuacaucucucuuuccacaugacugaacaaagugacagaguggaaagaccaaccccagggaccccugugcagacaggauacagggugggggcaccgaggcucugcagggacggugcugggggcugcaccacagguccuuggugaccaugcugcugaggacucagaaauauugaaaacaguugugaccacagugcagaauucauguagauuucacuccucaaagggagcucuguccagauccaggugcccacagggguucugggcacccacaggcugugcugccaccucugguccucaagggcuuuccgccuuuggcagcagcccacaguuaggcuucugcccgugucagguggcaucugggguccuuguccucccagcugucuuuauaaauggcaacucagaagcuacugcugaaacauuuuguggucaagcuaaaaauagucugcuggaauugugauaauccagcaaguccacauuucagaugcucucugcucagugcagggcaaaaccacaugacccugguuccaaccccacgacuucccagggaagaugaguaugagggccagggccagggcagcugcuccggaaguggucaggcuccuggggacucagauggucccauggcgagcucauggagucucccucuugaucccugccuuagggcagacccagguuguucacuggccugggcacacagcucaucagacacccacgagggcagucugcaggcagaauccaccugcugcccaggaagagagauggggggggcagcuggcugugccccacccugaccugcccucaaggagcagccacaguuagacuguuagcaagagaauuuccaauaaaugguccucauacaugguagcaacucuguaaagaacugcauguauuuaggccgggcgcgguggcucacaccuguaauccccgcacuuugggaggcugaggcaggcagaucaccugaggucaggaguucaagaccagccuggccaacauggugaaaccccgucucuacuaaaaauacaaaaauuagcugagcguuguggcggaugccuauaaucccagcuacuuaggagggugagacaggagaaucgcuugaacccuugagguggagguugcagugagucacgauugcgccauugcacuccagccugggcaacaagagugaaacucugucucaagaaaacaaacaaaaaacugcggccaggugcgguggcucacuccuguaaucccagcacuuugggaggccgaggcgggcagaucaggaggucuggagaucgagaccauccugucuaacgcggugaaacuccaucucuacuaaaaacacaaaaaaauuagcugggcgugguggugggcgccuguaguccugacuacucaggaggcugaggcaggagaaugacgugaacccgggaggcagagcuugcagugagcagagauugcaccacugcacuccagccugggcgacagagcaagacuccgucucaaaaacaaacaaacuaaaacaaaaaaacugcacgcguuuugcacacauggcuuuuuaaacgugaguuuccauguaaaggcccuuuggagauuccucacuugcaguguucaggucucauugaucccugugucucugggacacaagguugggggguguggaguuugaggugggcaggcagaggccagcagcagaucaugguucugcuguggcuuaaagagagauggugggaucaggacgaucaagaugcaggggccuggcaggaacccagcacaggggcuggggcacucauacaugacaugcgugagucacaccuagacacacuguaugcguguguacacacaugcaugucugcacacugcaugcggaugcacacacacacuacaugugcugacacgccccccaguuuggugagcagaccccagggaucccuggaacccccagaaacugugaggaggggaaauuccuucagaaggcacacucugugagccaccagcccuugugauggagcccucggauauaauggagaagauggaagcugcgccccacugggguggauggugaccaggaggagcugcugugggggcccagcccucccagcgggcagggucccugaucagaggcaucccccacaagcgcugccucuggcucuugccucugucucuugccucuagcgcagacaggacccuuugugugcggucccuuaggucucccaguacccuggagucagcaagcaccuggaagugccacuggcgggccaggacaaggggacuugucuaagggcccacgagccgggcuuggucaggcgagggaauucuuugggggaggcuaguggcagagggucagacuggccaagccugugaggcccgggggccccaggggcaagccugggaugaagacagccaagugugggcagggcucuugcaggcuccaguagggaccaggcuauucccgcugugcaccucauccacaccugccagcagacauugcucugaaguguccucccccagccagcagggcuccuuagggguacucggcccacggcagggcugugcacagggucugcacacaggcuagaguccuuguuuugcugaggacaagcagcggugcucccaucacugccagcccucggcguugcccuucucggucugggccucaccuccacugcccuauggcagauagccgaggcaggggugacaggaucuguguggauuuggaccuaagguaggaacaguguggggggcaggggagucacugaggaacacagaucucagucccagcaagggggcugaggccaagaccccugggcccaucggaaucugggcuggagguguggcuggugggagcacauguggacagaacugguuuuguguucaugggugugcaguugugaaugaaaugcugcgugcaccgugugaugacgcccugggaggaaccuugcagucagguuuucuucuaagcagaugccaucauuggcgagacggcagcacggccuaaagcagcggcuuagaggaagaaggcagggcccugggagccccagcagccaagggaggccagccaggcuugcgggugugggguggcugcuccacgggccaucggagucuuuaaagacugcacaagagaugcauuuuaagagaaaaaaagcaaacauuuccuuaaauaccaaugcuguuucugguugugaucucuccaucucaggugaauguguacgugcuuggaaagacguuucuucucuuggcaagagagcucugcaucaaugcgccggccauagguaggcaucugggugagaugcugggguguccggcaggcugcuguagggaccagcgugccaaauguccuuugaacaguggagggaaauccuguccaagcaugggaccccucaagguaagaaauguuucuuaaagcugcuaggagcucaguaauguggggccuuauuuucuaagacacagucucgcuguuguccaggcuggagugcaguggcacaaucguagcucacugcagccucaaacuccuggccucaagugauccucgugccuucgccucccaaagcacugggauuacaggcaugagaccgcaccuggccuggggcuugcuuucugcugcaaaaccagaaggccuguugucagugccugucagguggcaggaagguguagacagggaaacaagugcugcgugcugggagcaucuuguguggacaagguuuaagggacacaccuggcuccaggugccucuggacagauggggacaguggggcagcuccugguugugcuuuccagccacagcccucuuuugugguuuuucugccacuuuuguucuguguugugugcgaguuuguggaacuccuguaugccuuucuugauguguguuagguguaggguaaguccugucucucccucgaggcagcagcaguguucaugcaugcagaaucuaaccuagcggaaaagucuagaaggaaaggaucaaaacagcacucacugcccgaugguucugaccuacccuuucuuuaccaagcagaugacugguuuccauggcccgcuuagaggccccuuucuuacuuugccuguuugcaucuaggagcguauguccuuuggguagagaagcaccagguggggcugggucaccaacaggacugagcaacacgggcugcagcagcagaggggcaccggcugaggcuauacacucggcccaugcccucucccaggugccaagaggggccaucccucuuuucgggggucauacagguuuuccagaaaacaacugccuacaggguaugcagagugggaggagagagacaaggggugggagagccuguuucacccuauaguccacuccugcaacaggcugucccgcagcagugucacagcuagugacaguccccaggguccagaacgcugggcccagcagaaugcucccccgacagucuguucauaggguaggacucugaggugcuagugaugcauuaggacauagagacaaccaggcaccugguguuuccuaggguggcccagaagccagccagcaacccaggggacagaugggcuucacuggggcgcaguuugcuccuaaccacauagcauguucagcaugacagguuuucuccucgggaugggagggagcuguucuguugcaugagaaagagaauaccccacuguacaacugcuguagucauuuacugacacguggguguuauuuuaggcaaccuuuauuacagaaguccacuauuuuaagugacuuuuugccaauuuuagauuugaagggaaggucucaaguuaagcuuggaaccacuuagaauccaagaggguagcaggaagauccaaccccucaaagcagguggcaugggugccacugggaggggaucuggggccugucuugagccguaaaucuuccuccaccugagacgugcaccccacuguaccagagaugccuaagacuccaaucccuggguucuggcuguguggaaaaugucucuacacagucaagcuucagcugacuacaugucaaagagagacaaaguuaagagcagccuuucauggugucaagaagcaguuagcaucuugacuuccccuccacucacucgcugaccugcugcagccuccccgggcaccucaggcauagaaaaugagcucagggaucugcccacccuggaccccagucccguuggugcuguccgaggagcacuggaacuggaaggccaccuuuccacacugcacuuccgucauccccuccugcccaaaguagcugaguucgcugccguccaggacggcacuggccguguagaaggugucuuguucaaccuggaccggguguucaaaccagaccgggaagguguuacuggauccgucugacaugaacuuggucaaguucugagccagaaccaccccgagccgcuugagcucaaucuucacgcuguacucagccuucccagagcuggagccauacaggcccagcccugcaauaaauacccuucuguccacugcaaacuggaugcugucgcagcgcccgcgguaccgccacugguugcugcgguaggcagaagacuggaaucgguggcaccucugcggggcgaggcccuuccucuuggucaggggaaaguccaggcggggcuuguugguggccguguaccacaggaagaugcugugggucuccuccagagucaggaugucugacugggcagcgccguuggcaaacuccucuagggucaugguuggaauucggaccagauagagggcucgccccagaacaugccucuuguuucguggggugauuggcagccccugccucuugcacuccgccucggcccaguucaggacggccucgaagaccaccgccucuuugguguugagggccucccgagugacaaugaucuccagcgucugccggucuaucucacagaagccuucggaccguagggccaucucggccugugcgucaaugaccucccagcagcgcugcgucagcucgggcuccucaaacagccggcucugggacagcaggacgcaggcguucuuggcuuccaaacuugucuccagaaaguugacacaggcuuuugccaaugcugggacgauguacuucuuagcagcguacagaguggccagcaccgugucggcuuccagaucgaucucaucacuguacauguaccuaggcgaggcagggcccgcgucaggggcuggcucccaagcacccaucgcggggcugggccugggagaggaguccaucagcuccugugugcuucccuucagaagccuccggaggccgccuaaaacggacccacccgucccuccccaguagaguggacuuacuuuaagaggaucagaaaggcugcgggcuccacgucuggaaugugaauuucagauuugacuuccgccaggucuccguagaacauggcauagaagacggagcugccgacagccaagacguacugggaggagaaagcgccgccgugagccuggcucucccgcaggcugcgugucagccacacggcggacggggcggacggggcacgcguuccgagaggggccgccgcuacccaccuugugggcgggcaccguccuggucgcccccgggggccccacgacgaagugcacgucggccaugagcucguuguugaacaugagcgcguuccugcaaagguagaggcacgggcugggggcgugggcgcgcgcgggcgcgggggccgcggggcacgggcucaccucucgcgcagcguggggcggcagcaccgccagccggggcucuccuggugguuguugccgagugugggcggcgcgggcgcgggcggcggcggcgcuggcgcgggggcgcugggcgggcugcgcggcccggccuuccugcccacggcggcgccggcguugcuguuggcuagguccgcggccgcggcgcuggcgggagcguagaguuccgccgccaucuucgcgggcggggcggcgggggcagccucggcgccuguggacgccgcgccccgcgcccucgcgccgcgccggggccucgggagcggcucugcaagcaaaagcaaggaggucaggcacugagcgacgcggccgugcaggcaggcuaggggcagcagcaugggcggcggcggcgcugugacccgcggggcugccacccgcuccccugccacccccgccccugcgacccugcccgagcccagccuagcgcagcccggccaggcccggccgcggggggcgccgucccgcccgcccgcccgcccgagcccguacccgccgcggcgccggugcgucacgcugcgucagggccgcgccccgcgcgacgucgcugccucgcggccccgcccccaggcccgacauccucgaagcugcucgagcuucugcccagcaaccggcgcgagccgcgcgcugugcagagguagccguggaaggcggcucccggcgcuggcaggcggccgcccccagacccgcagugccaugcgcaggugcuugcgcccguucuucaguuagcgaucuuuugguuaggaacgcagguggaccugcuuguuuggccauuugcauuccggagucugccucuggccgcggccugugggauggucguugggcuuccucguucguucagaugcuucgcgauuuagcuugcuacggacgccagcagccagcgcuugcagagagcgcgguccacucugcucugagggcuuuacaggggcaggcgcugcuauuucccggcauuuuccucgaggaaauaggcacagagagguuagucgcgcgcugaaggucacacagccggcgggugggcaagucaggaucuggcccugggccugcagcccuggagcuugggccccagggcgcgcccugccucuguggcucugccuguggaucgcagucgcaggcucgcuccuuguggggccucuagccucccggccuggggcuaauccugggaggugcguggcauggggcacuggcuuugcugaugaggagaccagacuucagaggccgugucaccuggccugggccgcacagcuggugcaugccaagcucgcgugcagacgaagcuccagaggccuggcugucaggaggguuccuccccgaggacacacacgcaaccuccuggaccgccaggcuuuagacuuuuaaaacuuccauaugcaggaaaccccacaggacgcagccagcaucucgggucaugggugcaccugucaccgcaguccugggcuaaacagugaacaggagcucugugucucuguggucguuacaguuguagugaauguucccugggagaguccucuucagaagauauuugcgguauuuucaacaaaggacucuccaggauggaggagcaacuacaagucaggaaggaaaaggcugacaacccaguuuuuuaaaaaacgggcaaaggacgugaacagacaccaugcaauggcccagagugcacaaaucaucauuucucccaggaauggggugcccgagcccccaggcggcugaacuugagacuugucacguaguguugguggaaugcagagcagcuggagaucaccugcugcaggugggugcguaacuccgcacggccaagccguuuggaaagcuguagcauaugcaugagaguccggaaaguuccgagagaaaguguguggaugcacccgccaaggacacacccaccgaggccacagcugcgauuucauagugugggaccccacuggcaaagacacgcuggcugcuguggccgugguuucugucccagccgucuguuuccauagaaaaagguaacgggcauaagcaguuuccaggagaaauacaaauggccagaguggagacagccuacauguccaucagcaacagaaaggaucagcagguugugguggguccauuuggggaaugcagugagaaggaauaacuuacagcagcacacaagaccugggcgacagcugucuccgggggugccaggauagaauugcugagccgccagagguagucagcgucuugaucugcauggugguguggagcaugugaauaauaauuuucauccuuagaaagaaaccacccuuugcacuuugauuuuuaaauauguuacaguguagguugggcgcgguggcucacgccuguaaucccagcacuuugggaggccaaggugggcggaucacuugaggucaggaguuugagaccagccuggccaacauggugaaaccccaucucuacuaaaaauacaaaaauuaacgggcaccuguaaucccagcuauucgggaggccaaggaaggagaauggcucgaaccagggaggcggagguugcagugagcugagaucaugcuacugcacuccagccuggaugacagagcgagacuccguugaccaggcuggucuuaaacuccuggccucaagugaucuaccugccuaggccucccaaagugcugggauuacaggugugagccaccgcgcccagccuauucuuuuuuguuugugauaauggucauccuaauggacaugagguagugucaugugguuuugauuugcaugucccugauaaauaaugauguugaccaucuacucaugugcuuguuggcuauuugcauggcguguuuggagaaacgucuguucaagggcuuugccuuuuuuuuuugagacagagucuuacuccguugcccaggcuggagugcgguggugagggugcacugcaacauccgccuuccagguucaagcgauucuugugccucagccucccaaagagcugggauuacaaaagugcaguuugcccauuuuuaaucgauuuuguuccugaguuggaguuuuuuguauauucaggcuguuaaccccuuaugagauagaugguuugcacauagucucuuccauucuauaggauaucauuucuguuaauagauuccuuugcugugcagaaacuuuuuaguuugaggucaucccauuugucuauuuuuacuuucguugcccuugcuguuggugucauguucaagaaaucauugccaagaccaaugucgugaagucuuucccuuuguuuucuucuaaggguuuuacaguuucaagucuguguuugggucuugcaucgguuuugaguuaguuuuuguguaugauguaagguaagggucuaucuuuauuugcaaguggauauccaguuuucccagcgcugcauauugaagagaccauccuuuccccauugugcaagaaguucuugucacccuuguugaaggucaucugucugucauugucauuucuggcccugugcuguccuguccuguccuguccuguccuguucuguucuguuggucuguaggucugucuuuaugucagcaccauacuggcuguuggacuuuuuaauucuuuucuugacagugguaauuuauuugcuucuuuuucuuauuagucccuuugccuacuuuaaauaauuaauuuuguuaauuuuuaguuuucuguuauuuuaguucauuaauuucauugcuuccuuuauuuauuuauuuauuuuuuuugagauggagucuugcucugucacucaggcuggagugcaguggcacgaucucagcucacugcaaccuccaccucccagguucaagugauucuccugucucagucuccugaguagcugggauuacaggcacuugccaccaugcccggcuaauuuuuuguauuuuuuaguagagacgggguuucgcuguguugcccgggcugguuucaaacuucugagcucaggcaauccaccugccucggccucccaaagugcuaggauuacaggugugagccaccacgccugacccauugcugccuuaaauacacaaagcgcuugaguuaauaaaguuaccugaaggauugaacuuuaauuucuaacagcguuuggaggugaggggacuacuuguuuuugcucauuuuuaguuuuuuuuuuuuugcacuuggggucaaauggcauguccuaugugcuguuaccugaaauauauugaggguuucuuuguucuaucauaccuggucauuuucauaacugucccacagacacuggagaagcaugaugacuccaugggguacagaauuuagaacauccuugucagauugagucuauggugaugugucuuaagucgucccuuagucuuuuuuuuccuaaucagucugucaaauuucagagaaccauguuaaaauccccuauuauugugguuuugaagguuguuuccaguguuuuuccuucauuuaauucuuccucugucgcugugcgccugcagauuccaggcugcuugacauggguuccuuuccaugaugaaaugccaugccugucccgugccgcucugccacuccgcguuugcccaccgugccgccgcugcccaccacuuccuccuccacccuagucacugacagauuugucuugaaaaaaacacuuuuugcuugucuuuuuuguuuuuuguuuugagacauggugucagucaccuaggcuagaaugcaguggcaaggucauggcucaaugcagccccgaccuccuggacucaagcaauccucccaccucagccucccaaguagcugagacaacagguaugcaucacuacacuaggcuaaauuuuucauuuuuuguaaagaugggggucucacuauauugccuaggcugguuucaaacuccugggcucaagcgauccuccugccuuggccucccaaaguucugggacucacaggugugagccacugcauccggccccagauuuuuguuuuaagagauggggucuugcuguguuucccaggcugaccucgaacucccgggcucaagcaauccucccaccucggccuuccaaguagcuaggaauguagguaugagccacucugccuggcuugucuugaauuuuuuguuuguuuguuugagauggagucucgcucugucgccuaggcuggaguacaguggcgcagucuugguucauugcaaccuccaccucccggguucaagcaaauucuccuguuucagccuccuuaguaccugggaugacuacaggcgcacaccaccacccccagcuaauuuuuguaucuuuaguagagaugggguuucacuauauuggccaggcuggucuugaauuccugacgucaggugauccacccuccucggccucccaaagugcugggauuacaggugugagccacugugcccagccguugauauauuuaccaguguuuuugaaaugaguuuucuauuucaauaauuaaugagcaucaaagucucacccacauuaguacaucuuuuucuuucucucucuuuuuuuuuuucuguugcccaggccugaguacaguggugcaaucacagcucacugcagccucaaccucccgggcucaagugauccuacugccucagccuccucaguagcugggacuagaccacacccacuaauuuuuuauuuuuauuuuuuuuuuuuuaagagacagagucuugcugcucugucgcccaggcuggagugcaguggcaugaucuuggcucacuauaaccuccaccucccagcuucaagcaaugcuguagucucagccuuucaaguaucugggacuauaggugcccgccaccacacccggcuaauuuuuuuuuuuuuuuguauuuuaguaaagacuggguuucacuaugguguccaggguggucucgaacuccuaagcucaggcaauccaccugccuuggccucccaaaauucugggauuacagaugugagccaccacacccagccucacacccacuaauuuuuuuguuuguuuguuuguuuguuuuuugagacagagucucacucugucauccaggcuggagugcaguggcaugaucuuggcucacugcaaucuccgccuccuagguucaagcgauucuccugccucagccucccaaguaggugggauuacaggcgugcaccaccacgcccagcucauuuuuuguauuuuaguugagacgggguuucaccauguugcccaggguggucucgaucuccugagcucaggucauccacccgcccuaaucucccaaaguguugggauuacaggcguaagccgcagcaccuggccccggccaaauuuuuuucaaaaacuuuuguauagacuucgucucuguauugcccagucuauaagcguaucuuuuuuuuuuuuuuuuuuuuuuuuuuuuugagucagaacuucgcucuuguugcccaggcuggagugcaaugcugcgaucucagcucaccaaaaccuccaccucccugguucaagcaauucuccagccucagccucuugaguagcugggacuagaggcaugcaccaccacgcccugcaaauuuuguauuuuuaguaaagaugggguuucuccauguuggucaggccggucucgaacugcggaccucaggugauccgcccgccucggcccccaaagugcugggauuagaggugugagccaccgcgcccagccuaugagcauauuuuuuaucguucucuuuauuucuagcugcgaugauuguaucuuauugaaaaucauuaaaaaucuuagcaauuguuuuaaauuaucuaauuuuuuucuccaaauaauaucuauuuuagcagccaaaucaccacaaaucauugguuuuuaucuuuaguugugggugcacagcgggugcguguauuuuggggcaugugaggugucuugaugcguucaugcaguguguaacagucacaucaggguaaaugggacaucuuucaccucaagcauuuauccuucguguuauggacacccucagcuggaaaggggggcugcgucgugaguaugaauggaugcaagucauagccaccugagccugguggggcacagcagggcccuguggagucacaucccggccucaugcucggcauaggggagcgcugcuuagguccaugcagucgcucagggcccaggcugugcagcgcccagccuguccugcuccaggcacucccccguggcacugugccgugcuggcagaggugcacagcgccaggccucagugugcacacacagcccccguggcaccgccaugcugguagagaugccagaagugggcccuccucucacccaugagugucagcugaugccggccggcuggcgacuuguguacccagcccacgccugucuugcucuaagaguccccggaccguuguugcguguggugcugucugcauggucuggagggaaggcugcugggugugcgccccucuguguccugagcagggcggccaugcaguaggagcacgcugccuggcccuagcgugucugcagcaggcuggcuggcagcagguggccaguggcucuccuggguucggugcgauggcugcccuagcugagggucagagaggcuuuguccaggggaggggaacugguggggggccugggggccuggaaagacaagugcagguugccccaccccugggcugcgugggccgccugugcacgugccauggcacauggaggugggcacugaggugcugugucugccgcagacccgugccuguauauuccacgcuuugcgcaccugcuggaauucggggagaagaaccacgagguguccaugacugcccugaggcuccuacagaggaugaagcgggacuggaugcacacaggccggcgccccucgggccucugcggagcagguacagcgggcccugccugccugggggaugcuggucuggguccuggccucacacuuuccugacuccugagugcuggugggcugggccguauguuugcagagcacugagagcugccuccagccucccggggcugacucuggccuggcccaccgggguccucagcccuccaggaccuccuggcugccccguuggccucugcguguccuggcauaaggggcagaacucucagggcagagcggccuugaccccagguugccuacuucuggggugcggcugcaugggcaucccugcccguggucucguggggcccggcuucugacgcggacagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguugucgcuccugagggugccacagggcugccaggcugucccccgcccccagcugggcgacuacgcggacagugguguggccuuuuucuccugagaugcuagguugugcuccugagggugccacagggcugccaggcugucccccgcccccagcugggcgacuacgcggacagugguguggccuuuuucuccugagaugcuagguuguggcuccugagggugccacagggcugucaggcugucccccgcccccagcugggcgacuacgcggacagugguguggccucucucuccugagaugcuagguuguggcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacggggcugucaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggauagugguguggccucucucuccugagaugcuagguuguugcuccugagggugccacagggcugucaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacacggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacggggcugccaggcugucccccgcccccagcugggcgacuacgcggacagugguguggccucucucuccugagaugcuagguuguugcuccugagggugccacagggcugccaggcugucccccgcccccagcugggcgacuacgcggacagugguguggccucucucuccugagaugcuagguuguugcuccugagggugccacggggcugccaggcugucccccgcccccagcugggcgacuguucuaguuggaccucugugaccccccaggucgcagcugucacucagacucucacuuugcccuuggugcugguggguggauguggccguggccuggucaacuaccccagcuccggaauuggagccccaggucggcagggcccucacuccucauccgggcccuuacccucgugcccacagaguccacucuacccggcaggccagguaccggcaucccugcgcugcaggauucaguccaccugagaagccguuccaucugcacacaugaucuccauguuugcacuggagguucugggcccacuguggccuuggugaaccugugucagcugccagcuguggccucgccccuuuccugcccagccuggcuccgcauccucagaguccccagcucccaucacaagcuguguuucccgcacagucaucuuagaguuaguuuguuugcuuugagggauuacgugaagcucucggaagccuucauuuuaauuuuccuugauuugaaaauggaaugggugcagccgccacccacaauaagauagagagggucaugucguucaggaguagccaugccaagugagggucucacugccuggcacagacacgucuucucaggccaucaucuccgugaccgggauccgcaguguuguccugggccgccacagauguugcccugguucccagccgugguugacgaggcccgucucguugccuuccagcgcuccugguugcagccagaaugcaugacuucaggaggacugugaaggaggucaucaguguggucaaagugugugaguccacgcugcggaagaggugaggggcucucauucauggcauggggaccacacagaggcuucaucaguccagcucaggccugcuugccagagcaggcgccaccucccgggacccugccgucccccgccuggcugcuggccaggaccuagcccagccccggucacacuauggcuuggacgugcuggugggcugccucgccucccuccagagaguucccugcuaguccuucuggggccggcccuauccugcggaggcauccuccuccuccgaucccuguauuuuuuuuuuuuuuuugaggaacagccuugcucugucgcuuaggcuggagugcaauagcgugaucucggcucacuguaaccucugccucccggguccaagagauucuccugccucagccuccugaguagcugggauuacaggcgugugccaccacgccuggcuaauuuuuuaguagagauggggucucaccauguuggucaugcuggucuugaacuccugaccucgugaucugcccgucuuggccucccaaagugcugggauuacaggcaugagccaccgcgccccguguuucuaaguugaggcggagggugauguguaaaguugcccuaagucacaaacaggcaugaggcugucuuugacgucagaagccugguccgucuccuuuuugcuguggcccguccuggacuuugagagcccaggugaccccugucccagugagaagccggagugccauaagagguccccgcaucagugaaaugaguggcguagcaagccaggcaggcagggguggggcuuugcaccccggcuuugcugggugguauuugucgggguuccucacagcucgccugcaccgcagcccuguuucauagacuuugacaagguaaaugugacaguggaguugcugccaccuguaacugcugugacauuuaucacaaaucuuaaacacaggacugcuguuuuucagcugagauuguguccuguggcauuuuccaaaaccagcuguaaaguauuucacuuuaaacaucugaccauugauucuguaaaaaaaaucuuugaugaaacguguuugaagguuguguagcguguagaggcguucguaagaacugagccccauggcucacaggccugcagggccccuuccugcccgacugccaggugcugagguucuagcccagccuccucucuucaggccuucugagucuuccgccuaggauugggguucucuugugagggaugagggugccugugggccuuucuccuagugagcagagguccgggcaggaucggguagggguggagaagccgccagaagggaccugggcgccgaggggcaaggccugagugccaggccccguggaggaacauccgacaagcacaguucagguauuuguuuuuauuguuauuuauucauuuuuuugacacagauuuucgcucuugccgcccaggcuggaguacaguggcacgaucuuggcucacugcaagcuccgccuccuggauucaagcgauucuccggccucagccucccgaguagccgagauuacaggcucccaccaccaugcccagcuaauuuuuguuauuuuuaauagagaugggguuucaccguguuggccuggcuggucucaaacuccugaccucaggugauccuaccacuucggccucccacaugcugggauuacaggcaugagccacagcaccuggccuuuuauuuuuuauguauuuuuugagacaaaaucucacucugcugcccaggcuggaggccaguggcgcuaucacagcucguuacagccucaaccuccugggcucaagcgauucucccugaccucagccucccaaguagcagaaacuacagguguguaccaccaugcguggcuaauuuuuuuuuuuuuuuuuggguagagacagagucucacuguguugccuaggcuggucucaaagucuuggacucaagcaauccacccaccuugggcucccaaagcacugggaucacaggcaugagccacgcccaggcgaaagcucaguuuuaaacagcugguuucagagccaccagcuccauuucccaugucuggcuccauuuuaggcucacggaauuugaagacacccccaccagucaguugaccauugaugaguucaugaagaucgaccuggaggaggagugcgacccccccucguacacagcugggcagaggaagcugcggaugaagcagguagcgccggcuuuggugucugucugugcugggcuugccagccuuggggggaagccacacaccccgacugggguuguagcagagcuggugccaucccaaagccucauagccgcucuucagugcuaugaccagccagagcccgaggcuccgggaugccccucacacagacucugggaagugccaccucuucccaugggggacacaggcccauagcuccaccuccaucgcugcguaccccuaaguucuagcagccuguggucccuggggcccacgcggcaccccagaggcugcgcugugcaccagggccucccuucacgaagccucuugcccuguucccuuucagcuugaacaaguccugucaaaaaaacuggaggagguugaagguaaccaaccaaucuucccauguaaugcuucuguuuuguugggaaaauugauuuuaugcugacuuuuugcuuuuaacuuaugacuucaggugaaauauccaguuaccaggaugcaauugagauugaacuagaaaacagccggccaaaggccaaggggggccuggccagccuggcaaaagauggugaguccacugugcccggccccuauucagaccuuuaaaaugugcuagagucucagcagaucucuucaggaucagaaaaagaccuggaaagggaaggggauuaucuacagaauguaaguuuaccaccgggcaggguggcucacgccuguaaucccagcacuuuaggaggcugaggcaggcggaucacgaggucaggagauggagaccauccuggccaacauggugaaacccugucucuacuacaaaugcaaaaauuagcugggcgugguggugcgcaccuguagucccagcuccaugggaggcugaggcaggauaaucauuugaaccugggaaguggagguagcagugagccaagaucgcaccacggcacuccagccugggugacagagcgagacuccgucucaaacaaaaaaaaaaagaauguaaguuuccccuacaaaagacagcuuugcggggccauuucaaaauaugucaaagauauuuugggguaaaauauuuuuauuucuuucagggccugcuaccugucauugauguuguacuagagucagguuggaauuugguaucuguugcuacaaagucuggucaaucaucagaucuguguuuugauguuaaugcugaugagcugugccugaacuccaaagggaggggguauaagcggguauaaugaggcgugucugaccccgcccccacuucccaucauggucugaacuagcuuuucagguuucuuugaaaucuccuuggccaagagaagggauccauuugguugguuguggggcuuagaaucuuguuuuugauuuguauucuguacuguguauuuucacuuggggguuaguaggagccacgggagggccugagaacagaggcaggagguagggaggcuguugcaggaacccagggugagagaccuggcccagccuggucgaacucuggaaguacuuuuggggcagagccaacaguccagggaaugugcaugucccgggaauguggcagccggagcccccaaggcuccuggcaccugcggccugggcccacuugcccggggaggggcuucugagaggcugcucuguccagaggucaucguccacugacagcugcucucuggggaucaggugcuuucccccaaggagccauuccucaccauggggaccccuccgggacucagugcuagccaggaaucuuguauuggaacacauucagaagaaagcagucuaagacuagggagugggucaagcauggugguucaugccuguaaucgcagcacuuugggaggcaaauacaggaggacugcuugagcagaguucaagaccagccuggucagcauagugagaccccaucucuacaaaaaauaaaaaaauuagcugggcaugggagugugcaccuguagucccagcuccucgggaggcugaggccggaggaucacuugaacccaggaguucgaugugcagugagcuaugauugcaccacuguauuccagccugggcagcagagccagacccuguccccaguauacacacacacaaaauccagagugggauguuuuaagaugaguuuugccaaccuuaaaggaagaagcagaggcaaaaguaaucuacauaauuuauuugggucaagcuugaggauugcagccaggguggacauaucccauugccuugaauauacacucuggugagcagcaguuacacauggacuuuuucuuuuuuuggagacaggcucacucugucacccaggcuggagugcaguugcauaaucucagcucaccacaaccucuacccuguaguuugaagcaauucuccugccucacccuccugaguaguugggacuacaggcaugcgccaccacgcccagcuaauuuuuguauuuuuuguagaaacgggguuucgccacguuggccaggcugaucucgaacuccugaccucaagugaucuguccaccuuggcccgccaaagugcgggauuacaggagugagccagccucagcuacagauggauuuuuaaaggcaaaaagggacagugauuggauagauacaaaguugucuguugggaauucucauuggcuuacaauaguaacguucauucgugauuggcuguacaucguuaaacuauugggugcggcauuauuggguuaguuuagagcuacuuguggcaacagcaagugguuucaagaaaugaacacguagcucaaggaggaggagucacauuccucccgugaaaguucuuuucucagucuuuuaaauuuaccauugggugauuuuuaacagccuuauugaggugugauugccguaugaaaacugcucauauuuaaaaugugcccuuugauuucugaacuuugaugucugcacacaccugugaagccauagugacaaccaagaagacccacagaucuguggcucccacgggguccacaggcccuuggucaccacccccccuccugccccaggccaccagugagcuacuuuuuucacgauaaauuaguuguauucuguagaauuccguaggaguaggaucacauaguauauguuuuucccuucggcuuuuuucacaguguaauuauguugagucacgcaucaaugguuugcucauuuguguuguggcguggcagucgguaguccuucagcacgcugaggguguguguugagucacgcaucaaugguuuguucguuuguauuguguggcagucgguaguccuucagcacgcugaggguguguagccauucaucuguuagaggacauugcacguuugaggcuguuucagaugcgcucgugaacacucguguacaaguccuuguguggacguugauuuccuuuugggucaauugcugaggagugaaauugcuggguuaugugaaaggcaaguguguaugucuuuuuuuguuguuuuugagacggucuuacucugucacccagaguggagugcaauaguuccaucauagcucacugcagugucaaccuccugggcucaagcaacccucccaucucagccucccaaguagcugggacugcaggcgggcaccaccacacccagauaauuuuuacauuucuucauagagacaggaucuugcuguguugcccaggcuggucuggaacuccugagcccaagugggcggccacgaacugccugucuuuaagaaaugaucagguugucagccaggcgcagagccucacgccuguaaucccagcacuuugggaggcugaggugggcagaucacaaggucaggagaucaagaccauccuggcuaacacagugaaaccccgucucuucuaaaaauacaaaaaauuagccgggugugguggcgggcgccuguagucccagcuacucaggaggcugaggcaggagaauggcgugaacccgggaggcggagcuugcagugagccgagaucgcgucacugcacuccagccugggcgacagagcgagacuccgucucaaaaaaaaaaaaagaacugaucagguugucuccaaaggguuagcaccaugcguggaagugcaagggagcguguucccccugucugggaagugcggccugguuuucuuuucagggcuagacauucugaugguugugaaggaggagcuuggggugguuucauuugcauuuccuucaggacuggaggucuuuguauauguucauuuacaccaauaugucgucuucgccggaguguucagaucuuuuuccauuuuuuaauuggguuguguuuucuugugaaguuuugggaauucuucaucuguucuagauuuaaguccuuuaucaguuacgagauuugcagauaagccugugggcugucuucauugucuuaacgaugucuuucaaagggcaguucuuaauuuuuuggaaauccguuuuaucaguguuuuauggauucugcuuuuagaaccauuagaaauguuugccuuauccaaggucacaaaguuuuucuuuuacguuuuugucugaaaugucuguacuuuaacucucccccuaggucugugaucugcuuugagcuaacuuccgcgugcagugcgaggugugggcugaggcucguucuuuggcaccugaccgccaggcaccgugcacugacagccguucuauggguuaccuggcagcuugguagcauuguuuuuugucacaaaagcgggcacccuggcccucugccugguuaacagguggauuguguacaccuaggcuccaccgaggacaccgcguccagcuuguguggcgaggaggacacagaggacgaggagcuggaagccgcggccagccaccugaacaaagacuuauaccgggagcuccuugguggugcccccggcagcucggaagcagcaggaagccccgaguggggcggcagaccuccggcccuggggucccugcuggacccccuccccacugcagccagccugggcaucucagacuccauccgcgaaugcaucuccucucagagcagcgaccccagugaguucugauggggcccugggggacgcugaggucaucgggagaucuuucaggcgugugccucucauggggagagccggaugcugccauccucugucgggaggugugguggucucgggcggugggcuugggugguggcaccaccaguccccccaauggggcugugugggcgucagugguccuggcgugaagaauugggugugugccgacgccagaaugcagugagucucgucacccucacugggaccgccuucaggucacaggggccacggagaauggagcccacaaguuguguccaggagucccauggggcagcuccaccccucauccgcuuguccaacauggucgggggaacgucacuugcugagcuugggcguggcaaugacgaggcaccccugccccauagugcccaggccaggccaccgugcccaucuugcccccccucaccuugcccauuuggcugggagcucuaggagaaaggugggucccaucccccaucccugccaggacaggcuucccuggcugagagccuagaccuuccugcaacgcuucacccucaagcccugccucccgucgggcaccagggccuggccucugugugaggagccaggcgaauguuuaucaagugauaucugggccgggguagagacaauccugaugguuggggcugcuguguggguggaacccaggcgagucacacagagcaacaggcagaggggacaugcacaggcccuggggcagccagcggcacagugacccugagcagaaagggccauucuggcuggagcugaggaagggcugccugugagugcugagaggagccgucucuggccucggcccuggagcagcauggcaggagagcaccucagacagucuggcccugugcuggaguugacuuggcagcacggggcaggcagcuauggcguggggcuguggcaaggagaggcugucccaauuccaggcugugcagaugcugccuggacugcguggggcugggcaggggugacaggcagguuuugggguguccugagcaugaucauggagggcucccucaggccuggacuccggaaucauuucuauucccucauuucuauccccagaccuaugggcucagugauggggagcuggcuccccugagcacagacccccaucucacuccguggccugaccuuuccuuccugcccagcuuccgugcccucccucggucuuuggggccugacagccucugucuccuguucuuaaaaaguugcuuuuuuacaaaaagcacagaagugcugggguuuuccuuugcagcuucaguucaguguucugcuggcuucgcuuaguguccugagcuaggcauuuaaagaggugcggucaugugggcagacagggcgcgacccaccagugcagaggaggggacgggguucuagaaagcccuuagcccagacccaggguccugagccagcccaggugguggccacgcuccuauaaucagugcuggcccugagugacgcggaugcugugcuucccuccagaagaugcuucaggagacggugagcuggaccucaguggcauugaugaccuggagauugacaggguacguggcagcaccccuucccaagaggggcugggcuugggagggcgcugcagcccaaggagcccugaguggucgggcgggguuggccaccuccccugcccagagcccaccccgcugggugaagugggcuccuggccuucuggccacuguucccgggacccccccccacacucucuucuccagugucggcucgggggcggccugucgagaggccccuggcuuugcgccugguccuugcggcccucggcacauagccugcagcaggcacacaucgcacaaauagcaccaggggcagccccucgaggggucucuagacacaagagggcacccacugacuccacaugcgcugugcgcccccaaaccccagggcuuccagccauugggaccagcucuuugcaguuuaucucaauauacuugcccucugucaggcaggaagucgucuucccugauuucauggccacguggugccucagaccccuccagccuggcccaucuguaccugagugggaggcucucacccucacuuggccccuuugugggaaccuguggccugcacucuggcuggccaggguccuggugccggcagggcuugcaagcugcccuagggggucucacacauguggccugcgugguuggccuugggacaggccacagagcaacagguccccaacucgccccgcgcgaugaggccucagcccaggcuccgcacuaaauagaggcugccccggguuccccuuccucuaacgguggaaauacuucccgcuggccagcgcgaccuuagcaugccccggugugcgaaggcuaaaagccagccccacuucccugugcucgcccaguacauccugaaugagucggaagcccgcgugaaggccgagcuguggaugagggagaacgccgaguaccugcgggaacagagggguaagcgccacccgcccacacucacacgcaggacgcacaguccccaggccuggggcgugggcccucagugacgcuggcccccuuucugaacuuuuagaaaaagaagcaagaauagcgaaagagaaggagcucggcaucuacaaggaacacaaggugggcgccugugacgcugggccuggccuucuuggggguguccagguuacggggggcaaaugucucuggaaugucccuuccccaugugacaggagggucuaggccccagggcaggcagccggaggccaugugcucuggaccccagacccacguccuuaaccacuagguccugccccgugcuggccacaggcgcccagccgucggccucaccuuggagggcgugugcucagcuuugggguaaccuucuggaugcagcaccggggcagacugucgagacucggggcuggacgcuggggucccugccuguguuaacggguuugcucuucugacgcccugggaaaguccgacugucaugccucccugccuuguggccgucacggugacuugcucugccagcuuacucucuggcggaaugugccuucagccucguggugcaggcagcagugguugagccucugagugacugagcaggagaaaacacggggagccaguucccugccugcgagacuggggucccucagacgaagcuggagguggcugggauggcagauguggggccuacccgcucagcaggacccggggagcuuguggucagagaguuaggagcccagggacuccaccccacccagcagcacgucccaggccuugcugggccacgcaggaaggucaucgugcagcggggggcagcagggguggugcaggcugauugcccugaaguggucuauggcuccagcuccuagaaggagauccagggucuucgggcagcuggggccuuugacgugggcagcggugcugggguggauugucugucuucacugaguagccaucucugcugcagcccucacagugcagcagcacaucgcccugccgugugcauguggcccugcccugugugggacccaggggcagcagggcccugagcaccuguggcauguuugcugcuguugcugucuggaggcccugccagcacccaugccaggccacgugccccacucaccugggagggcaggauuugacgugggcaggcccagagagcaccaggcuggcccacauucuggggggaggaggcaggagcggcccuucugagggccugagccaggccucacccgccugcacuccuggccucacguggagccccugaugguggagugcagugggcgugacucacgggaggcauucuugcuuguuucccucaagcccaagaagucuugcaagcgacgggagccaauucaggccaguaccgccagggaggccaucgagaagaugcuggagcagaagaagaucuccagcaagaucaauuauagcgugcuccggggccucagcagcgccggcgggggcaguccgcacagggaggaugcacagcccgagcauagcgccagugccaggaagcugucacgaaggaggacgccggccagcagaaguggggcugacccugugaccaguguggggaaaagguaccauccuguccugaguggcuggguuagggcagcagcccagggcgggcagaggcccauggcuucggguccuggagcugccgggggccagccggggccacagaagugccuggaguggcauuugccaccugcaugcuggggacuggugggccuucuccggcaccuugacagugucucaacucuccuuggccuggcaggcugugagcggacgggcggguccagcugucagggggguccugcagccuaggcucuguuuugucccaaggaggggcugggacaauccguggggucggugccuucuccagccuggguucgggaagaagaguccccagcccugccgcccugugccugcucugcgcacccuggcugcauugccgucucugcugaggugaugggugagagcagcacacugcugaggaaggaggauguggguggagaacguggcugagggacgucaaaggcgggaugugcuggccucagcgcacagggucacgaggcucugcagcuccaugcagggccgccuuggagugggucggccucugugcacagcuugccgcuggguggcggcugcaggcucuccugacgaggccaugggcagcugggcucaccugcugcgucuugggggccuguggcugguccaugugucccucuggcaguggagaugggguuggcggcuuagcuucuggguccacccuuuggugguuccgaccuucacuccaccccaccgagucuccgggcugggugugucugcugguccuacugcuucuugggaucucuugcguugucuccagcugcuuccgccuguggggcagugcugacucucggcagccccgucagggccuccuguuguuugcgguauuugcggugguuucuccuuggccuuuugagcugcuaggcuggccacugcaccccgcgagaguuggcugugcuguggcccugccccugccccuccccuggggugcccaggugcuacucugugagggagccugaccuccuggcaggcuggugcuucucagccggcgucucagccccucaggagggccgcaugggcugucuccuccacaucagccaugcacugguccucugggggugcauuccuagcacagcuccuggcaugcguaggaggucaguggggcagaggugaagucagggcaggucuguggcucgguuccccugugccugagcacucccagguccgaucugaggcuuuagucuccguguccucugccugccuagccagccucugucagcgcuggagguggggguccugucccaguugggugauucuggugccuggugacaggguucacagcccccucugucacaucugaccagcuggcccagacagggcccgggugugcaugugugucucucuguguguguauacauguacaugcagugcguguaugccuguaucugugugcaugcagugugugccugugucugugcgcaugcaguauuugugugcaugugugugugugugccugugucuguguacgcagugugugugccugugucuguaugccugcagcgugugugugcaugugugugugcgccuguguaugcagugugugugcaugugugugugugccugugucuguguaugcagugugugugugccugucugcguaugcagugugugugugccugugucuguaugccugcagcgugugugugcaugugugugugugccugugucuguguaugcagugugugugcaugugugugugccuguguaugcagugugugugcaugugugugugugcagugugugugcauguguaugugccugugucuguguaugcagugugugugugugcaugugugugugugccugugugcaugcaguauuugugugcaugugugugugugccuguguaugcagugugugugugccugugucuguguaugcagugugugugugccuguuucuguguaugcagugugugugcgccugugucugugugccugcaguguaugugugcaugugugugugccugugucugugcaugcagugcguaugcacacaguacgugugugcguuggugcacucaguacgugugugugugcauguguucuggugucugcacacagugugugccuguaucugugacugcacauagugugugugcauguguguaaguuuuugugugcaaaugcaggugugcacgccuaugugucucucugugcaugcagugugugugcaugcaacauguguaccuguaugucuacagauuguggugugcaggucuuugucucuauguacacgugugugcaugcaugugucuguauacacuguguuucucugugugcguggggcgugugugugugucuuaagucucucaacugugugcagugugugugcaucugugagucugugugcacacacaucugcguguucgugcacugcuuccugcuuuagaaacccaucagucuuccccccaacauggccaugaucugauucgggaauauuuaguguucuaagacggaagcaugaagaccucagggcuggggaccccccacacucccacccccacucaggccugggcagcucaggcaguuccagcggggcaggggagagggggucuaccuggggacagaagggcuugucccgguugcccuugcagcccaugggggcagcuuuucacccacacucgggugaggaaaaagggauuuggaccacuuggaaagaggcugaggcuccgacguggggaggggugguggggagggaccaucaaggagggguucagcugaggaggcacugccucagcccagcgaccacagcguuccucagcagcagcugugcugccuuggguggcccaggcauggcagucccuccuugcugugggggaaccagccugagcugcacccccuuucucuuuggcugccgguggcugccuagcccaucucccucuggccaccugccccugguccugcgucaugaugcaugcuuccccugaugacagacaacugcagaaccugagcugggccacucaggggugugggcagcugagccacgcaggggugugggcagcugagccaugcaggggugugggcagcugagccacgcaggggugugggcagcugagccacgcaggggugggccaugcaugggugugggcagcugagccacacagggaugugggcagccgcucccuccgagcuugucuccuccucacucuguggucacucgggcugcuuugacccucggggucuuccucuagcccaugcagaucagucuguccucaugccugagcgucccacucuggggacaggcagaggggccagugugggcugugggccccagcgcccauaucuggaagggggacaaagugggggcccaccagaugagcugcccucuugccugcuuacaggccccaggauccccccaggcugggcuggggccgagcuucagccaagcggggucagcaggugcuggcgcggcugcgagagggagcagccugagcccaacaguggguuugcgugaacaaugggccgcagcgccccacauccucaggccccuggcuggggacccccguacaggccaaagccauggccgaggugaugccaggugggagcuuguucuccaggcgcucucaggcccucccguguggccuggcugccucagguucacacaggauacugcguggaagagggggaagcccuugagacaggcccccagcuagcccgcagaccccaggagcccuugcgguucugcacucaugaacacuacgcacccucucuccagccggguucugcaggaguagggagcuuucuggccccccagggugaggccuggcacagcugcuuccugguucuggaaaagcuggacuugucugucaggaccuugggucagugcagcaggaccuuguggcuugaauuucagccuguccucagugccaggugggggagggagggugugucccugcaggaagcgcacccuccuaacagcaccgcucucccuguagccccguauuccugcccgccagcaucugcuccucucuagcuaagguacagucugccaaagucaaagaaacugccucuuccagagguugcagugggccgagaucgcgucacugcacucuagccuggcgacagagcaagauuccgucucagaaaaaaaaaaaagaaaaaaacuaccucuccuugagccagcggggucucagggcccuucucaaugggggccugcuggccucaccuuccagagcaugaaucuccuggggacuuagucccaccggccaagaucaggccucccacccaacugccaggccugccuccuggagcgccagccacuucuggagagaccacaguggggugucucauugaggucagccugcugagaagccccgcugcagggccagcugccauccccagaggcccccacuccacugcacagugggccuggggaugggaguggggagggcggagcagcagcugucaggcuccaggaagcaggcuggaggccuggccugaggauacagcaccaccaggagcccugguguccagacugucuccagucuggagagggaccacauggggagcccggggccucagccuggcucacaccugcuaucagcuucaccccgagcagagcuccacgucuagauguucugcuaagguccaccugucauggggucccuucccagugucccgaggguucaucugacacgucagagccaggcagggcccugccucaggcccccuaccgccuccccacacagcugugcccuggagggaagggcucugccccgcugcguccuuccccacaggcccugagcccucucauugcccgcccgacagcccuguguguccgugcuggagguuguggguaaugccugcguccucuccccugggccccccugucucccuggggggaccagcagucuccaagaagacuuggcauguggaaggcaccuuuggccuuuguguguggcgggccggcgagcaggcccugugcaggguguugucagcagauguagggauugcccugggccuggugaggguuggggaagcacucucgggucugacagugucccuucacccucccuccccuccucccugagugagguagggcaccaggcagcuccuugagggcucaggcacuguuggaaggggagugggcuggggagcggggcgucugcagcuucuguguuugugucgagugcugcucgcuguugagaaugugaacgggucagagcucuguguugaugugcagugagcacugauggagcacacagaaccuggacgcagaaccaggcuuccaaagggacagagaaacagucaauuaacacugggaaagggaagaugggcaaaagggaacaagugggcaggcguucgggagccugggcugaggccgccaugcugugcuuccuuuugcagguugaggccucuggugucuacgcagccagcaaagaagguggccacgggagagguguguugucccacgcagccagggcagggagaccuugggaggcagcccacuucuuccugggcccagaugcuuggucugugaccacagggagagcaggccugacagaggcgccugccccugcugccccauacuugccuggcauggccagagaaucgaggcccgagggugggagcucccgguugccggagcaggagcgggcaggaaguggggaccguugugugccugcugcucagcgcucgggccaaggcugagcagccuugcugugggccuggugccugcagggagccuguauguaggaagcaggcacugccaggucacagggcccagcccuccagggcucaggggucuuucaccuggacugucacuuguuggggacuggucuggcccaggaaacgagggugaaggugcuggcagguggcgggggcuggggcaggggccggagcagagccucugucuguguucugggggucagggcaggccaagcccccgggggcugaggccacaguguccucggccgaggccuauggucuggaaagguguucugcaugcuccccgagcacugggguggggcccaguaggauacaggagcaggggcuggcagaggccugagggugggaucuugaugcugacacagcucauggcacagcccccaggaggccagaaggggccagugggccugggagcccuggccaaccccgggagccacugguguggcgggaguggcugagcauccugggccagcccuggugggucugaggggucuguugagauacacagggcucccagcucugugugugucagagccccacuucguuccaggcuuugcucccaagcucucccacccucggagcugagccugccaggccccaggcggugcugguggagagcgggcccgugucauaccacgccgacgaggaggcugacgaggaggagccugacgaggaggacggggagcccugcgucagugcccugcagaugaugggcagcaacgguggguggggcccgacaacagggagggguucaagggaaauaaaggcaucagcuacugccccucaugaucccugaacuugggccuguuagcuucaaacuaaauuucuguuucucccuggaaagaaauuugaacuaagacauuuuguaaauuggucaugucgauugugagguuggaggcagccagggucagagaggcuagggacggugagguacccaccacgagggccgcccagccagcagcacgagguucccggaucugcacaccaccacggaccugcacacccagggagggaggcugagggagcccacacugcucucaggugcccucgacgaggagcaaggcccugcucugggugcaugccagucccgggagguggagaggagcccaagauggcuccuggcggggcgcggggggcuggggcuggggcuggagccugagucuucuaggggggcaccaggaacagggcggguuggggggucugggcuccugggucccacagagacccugggcuucaugacugugcucuucugcagacuauggcugugauggcgaugaggacgacggcuacugaaguguggccuccaggcaggugauguccuggcagggggccucgcgggucuccucagcaucagacgggcuuccaggaccgcagcaggcaggccccagcgccgagacuccuggugacagguggcaccugucccacagcccucgucccauguggaacuuaccauugggauuguguuucuauucagcaagggaaaccggaccaagcgucugcaugugugugaucagaugugggccgggugugugcagggcugggucccgcugccugccgucgacucauccaaggacccuccaaggcuggcagugugguguugcuacuauuaaggaaacaggcuuggggcagccccacugcugguccaaguguguggagggcugagugugcuggcccugugacucaggaccagcucuggagucuccagcccacccuccgcaccguccccuccugagcagcacucggcgccagcagccucugccagaguggaagccagagcccugcagguguccggcgcagccgugggagcugaggaucuggcacuugagaggcagcagcuccuugaagguccucugccuccagcuguggcccugcauccagauaccugccucguccgaggcagacacccccaccccugccuccuccagaccccccuccccgcugccugcaccgccuggagcagcaugggggucagaccccugcuccagggccacuugaguugugggcccaggagcccugcggcugccggcaggugaacugagugcccgacagcugagaccggcgcccacccguccugagcauagcucuguaggcagugcgggcauagccugcauaguguccuggcgcugggaguuccccguggacagagccagagggcaguggcgcucccugucagagcuggaucaggccccccaucgaggagggagggcagacggaggcccgagagccuccccaggccucuucgugggaaggccccaguaccacucguaggaggucucagcucuggcauggcugccccggauguggccgagggggcuucacccuguguccuuaggaggggguggccuugaggcagagccgugccucacugacccccaggggccucauccuccccauggaaugggcuguauguccugccccaacuuggcccgcagcaggccagaccccccuacccccgcccagagcucaguagccagccuggguccugccagggcuucucgagggcuugggggaagaauagauuuaguaaagcaggaagaucuguuguuacuuaacagaaa

SEQ ID NO: 193034 - RNA, 119718 nt, Homo sapiens
cacggaacagcccuccugggguccccacgagccgcguccugcugugccccggcgccuacgcagcagcggccgcggccgcggugggcacgcacgguuaccccgggcagcuccggccgccagcugcagccccgucgccucggccgcgccagccggcugcgggcaccugggggcgggcugggggcgccggccgcggcaggaggcgcuguagcgagggcugcggcgccgguccugcggcggccgcgggaggcagcggggcaggcgcugugggccgggcuccuccuccggcuccugcgcgaccgccucccgccgggcucugccggcgcccgccguccccgcagcgccgcucugcgcccgccgccccgagcgcccgcgcggggcuggcgggagccucggcgggcgcgcgggcgcgcggggccauggucguggcccccugacgggccgcggccgccuccaugaagcggaaaagcgagcggcggucgagcugggccgccgcgccccccugcucgcggcgcugcucgucgaccucgccgggugugaagaagauccgcagcuccacgcagcaagacccgcgccgccgggacccccaggacgacguguaccuggacaucaccggugagccggccagugggcgcgcggagggccccggacggccgcacccggcgcggggcccuggcccaccucccaccgggcugcccggggccuccggggccgggccgaaaugccuucgcccccacccccuuaaacgccccggccgccacacccccuuuaggagccuggcuccugaggagcgccccccgccccgaguuucuagcugcgugggcugcgagcuuuaacuuuagcuugugcacccuccuccaccagcaagauggaccgagggucaccuuucuaaguugcgggcgucagcccggcgccucgaaccugcagcuccuccccgcgggcugcuucugaguuccuguggauuccgccuucagggauugcgagcccgguuggcccucgcgcgagucacaaccucugaaucagccccugaggauuccccgagcgcgcugaacgcgccuggcacgggagcugccccuuuuuggcguuggccaaacccccgcugcuccguagccuugggacccugggcgccgcguugcccguccggcgcguaagcccgagccccucuccugggccucccgcgcccugcccccuagcgcgccccccgaacgccuccgccucccgggguccgcuccccgccggggccucgagaaggaaggugucacguugguggcauucgagccagccggcaagacgaauguccggguugucacuuuugagaaaucccagccagccagagcagguagccaagcagcccuucgauagcuguucuguuagugcugauucgacuguucuuggagacucauaaauccaauuuggcagcuguuagguuugcugggauugacagugacgcgugugaaggcauuaaaugugaugauguauguggcaacgcuguguaaacagcagagcuguccacgauuuugagggaauuggcagucuguuuucaguggcggggaaugugucaaccucggugcguggcguuauuaaaaacuguuuccagccccuagccuuugauaaaccagguaagcuggaguggcgagaacauuaaguggaaguguuuagacaaacacagacguuuaggagaaauaauauucuagguucauggacaaucuggaaacuaaguucguuuugaaaugaagcugagagcagagcggguuucucggcuuugguggauggcccuugggaaccagagcgggcauaggaagggguugcccugaguaccaguccccggccgguagcugcggggggugugcgggaggugaagccugcugagacugagaagccaagucccgcuaacguugugcccuucccaggagagggccucgccgaggacggauggggcugggaacgggugggccuauacauaguuucugcccguuauuguuuauaccucuugaaaggaucuguguugaaugggauuuaauuuuaggacaaguaaugcauuuacaugguacagaacuccaauucuaaaggugcacaggaguacgugcagaaaaguuggucucacagucuccaaguguccuucucuagaggcaacuacucuucccaguuucuugugaagccuucuagaaauaggcugugcaugcauacuauauauacuauauauucucuaccauacacgugcgaguagcacacauguuguuuugcacauuuuuccguuuucauaguguuucuuauuagaaugauuguucugaguuggugcauauaagacuggcuuacuugauuuuaauuacugcuuaggccaauguacauacgguuuuaugaauaaaaccauuaacaaguacguauggauuuaaauguuuauguagauuugaauguuuuuuaaccuauuuagacagucccuguugaugaacauuuggguuuucaaucagaagguuugugacagcaaagucauuggaauaaaucuuucuucuugauggagaugaaauauguggcuagucuucgugaggcagucaccaauuaaucaacuucagaaaaauagaaccaagcagaauacugaggaggggugcguuacaggaaauaaaaaugcuaucagagggcaacccgcucugguccccuuccacgcugcggaagcuuuguucuuuugcucuucacaauaaaucuugcugcugcuaaaaaaaaaaaaaaauccuaucagauugcaagcccuaauaacggaaggguccagcuuuaauguaagggagcuccaggggaguaaagguuauagucaccuuucccugugacuucucuaggugucccucagugauagucuuggcuuccuggaaaaaugauacuuaaucagucuguugcagugugauauacaaggccaauuaaaguaucuucagauacagaguucagauuacuuuuuauugggcuuuugggggaaggcuugaggccuguccucagcaaguggcaaacuggucccuuccuucucaacguguuuuucccuccauuauuguuuucuuaauuuaaaaagcagugcaugcacacuucuaaaaagucaaacauuaucaaaugaguuuuuuuuuuuuuuugagacagagucucgcucuguugcccaggcuggugugcaguggcucaaucucggcucacugcaaccucugccucccggguucaagggauucuccugccucagccucccaaguagcugggaauacaggcgcccgccaccaugccuggcuaauuuuuguauuuuuaguagagacaguguuucaccauguuguccaggcuagucucaaacuccugaccuugugauccgcccgccuuggucucccaaggugcugggauuacaggcgugagccuucacccagccuaucaaaugaguuuuauggagucuuccucccuugguaauguuuuuccuccuucaauuuucugugcacauucaaguuucuggaaauugugccauaccagcaagauuaguucucuuuuuuuuugagacggagucuugcucuguugcccggguugagugcgguggagcuaucucggcucaccacaaccucugccucccggguucaagcaauucuccugccucagcuuccugaguaguuggaacuacaggcauacgccaccaugcccggcuaauuuuuguaauuuuaguagagaugggguuucacuauguuggccaggcuggucuggaacuccugacuucgugaucccccccagccuagaucucccaaagugcugggguuacaggcgugagccaccgcccgcagcugauuaguuaucuuuugauggcugcauuauauggccaaaucaugauuuauuuaguaguaauaaauagcugguuauuuggggguuuuccagucccuauugcaaauggcugcaguagcaucaauguaugugucuguuuauaugugugacuauaucuauagaguguauuucuagaggugaaaacgccaggccagaguacauauggacuuuauccauuccucaguggacuuuuuggcuauuaggaauaaugcugcugugaacauucauauacagguuguugcauggacauguuuucaguauaacacccaggaguagaauggcaggaucacaugguaucuccacguuuaauguuuuaaggaacugucagacucuuuuuccgaauggcuacgccgccagcguucccacaagcaaugcaccaauuauuccacauccuugccagcacuuaauauuggauugacaagauucuuucacaguggaguagguuuguaaaaauuaaugcauauugucacuucuguccacccugcccuuaaauacaucauuuuuuaacuuagucccuugacauuuuuauugcagccuauuuaaucuguaaauugaauucccauagaucccaggauacuucguguguguguauuuaauauaggaugcuuaaucccuauuuuuguuccugucaucauuuguuauauaaucacuauuguuuaguaucuagccacccacaccacuauacugggcauuuacucuuacuaggagcagacuaagggguuuaacucucauuccaaccccauccaccucucacggagccauucauucaccucuugccaugugcaaugacacggauuuuuuuacuugaacuauacugcuaguucaguuucaguccaccaugaaaacaaaaggucauaaagacaguguaggccgggcacagugucucacgucuguaaucccagcacuuggggaggcugagguggguggauaaccugaggucaggaguucgagcccagccuggccaacauggugaaaccccuucucuacuaaaaauucaaaaauuaacugggcaugguggcacgugccuauagucccagcuacuugggaggcugaggcagaagaaucucuugaaccagggagauggaaguugcagugagcugagauugcgccacugcauuccagccugggugacagagugagacuccaccucaaaaaacaaaacaaaacaggcgguguaaacuguaagcauuaaagcuaaaaagaugcuggguacagaucagaaugagcuguuacuagucuaggaaacuggaggaaguggggagguugaggaggguuuucaaggaaaaaauacuagauuuuucuaugaaccuccuuaaugucagaggucugaaucuuuaucucuauuuucccaucccuuaaauagggaccuccauucauggcaguguacuuucuccuuuccucaggaaaaaaaaauuuaaagacucuaacacuacugcauauaucuauguuugauaauuuauaagauguaauaguuguugcagagcuuugauuuauuuuacuauuuuuauuuuuaaaauuucugauuaggcugggagcagugacucaugccuguaaucucagcacuuugggaggccaaggcgggcagaucgcuugagcccaggaguucaagaccagccuggccaauauggcaaaaccccuacuccggaggcugaggugggagaaucacuugagccugggaguucaaggcugcaaugagcuguguucauuccacagcacucuagccugggcaaaagagacauagugaaacuccgucucaaaaaaaaaaagaaagaaaagaaaaauucugauuaguaaagaauauugguaauagcuacuggcuaaaagauucuuggugguuuguguuaaauuucuuuaccuuuuuaaaaacaaguuuucgagugucugccaugaucuaacuuuuaaagacugucuguauuauaauaguaaauaauuuuauuggaaaaacacuaauugaggucaggauugccauuuuaaagcacuaauuaauggugauauauuggauacucaucaaauaaacaaauacagcauugucuccucccuccuuccuuuuuaagaucuuuaaaauucacagcagacauuagacagggaaaauuuauucauuaauucaagaaguauuuauugcaugcuuacuauguaaaauagucaugcauauucauugcagugauggaaguauauuuuucuugauagaaaaggaaugcuguuauguagaacacugagucaaggaaaaaaauugcuuuuucuucaagaguuuuguguuauaguagauuauccaguuucaggaauugaagcccaucauaguguguagugugcauuuuucuucuugccuaugucuugguucuccuuuacuuacacuuaaauuugucuguaaugugaauuuguuuucuugauuucuaugcuugcuuaauucuucaacaucuucacuucugauauucauguuaguuaucugcuuuaaaucuaauuccucaggcacuccaacaccacguggaggcaacaguuugacaguuucaaaugucacuccuuaaguggacauacagaguaguugggcacagacaugaauggaagguggaauaauuguguugcagaaaugguacugaugccagggaguugccagucagugcaaauuguaauugcucugugcuuuugaaugggaaggaauguucccaguuucugcugggguuaggaagagcuggacugaaaccacacuguggauuuuuaggauggaagaaaggcauugaugcacacaagugacauuucuuggaaauuucugagauagucugugggaaucacugaauugauaggacaggggaaagaauuucaagagaucaaaacccuccacauuccccugugaagaagccaaagggccagagauaaaauugggccacaaugauguaguuucuuuuuggcaaagccaugacuaccugacuuuuacuguugccagcagauaaagcugcuucacagaguuguacauaaaugauuuauuggauaucuccuaguuaguccugugcuacuuaggcuaggagaugaauaauuaccuacugaauuugaggaaaaugagcaaaacaaguacaucauucaggucuucugcaggucaugcuguuuuccaaauugacugucauuaacagccccaguuuuccggauauuuuauucauucaacaaaugcauaaugaauaugugcaaaugaauaccuacucugccaagcuuucuuccccucaagugcuaaaaauagagcacugcuagagauagucccugcucucauggaguuuauguuuucaguguuaauugagaaaauaacacugggagggucugagggagaacuagcauauagaguaaccauaucgcauauugcgguugaaaucuuuagggaagaaaaacuuuaaucaaagaguuuuugaagagccaauucuaugaggccagcuaagcuagccacuaggcaugaggacacuggggaaaccuagucucugccccaucccaggguugagcacagacagauuauuaguaaccuuuuggagccucgaugcuuucaucugccacagauuuguugugagaaugaaaugaaggggaugcauaugaagugccuggcuugaugcccauugauggccagggcugcaucaguguucucuugugucacacgcgugacagcagcugcgaggacaaagggcaggcugaggcacagucaucacggcuggaaggguuucaagcuaagaagcaaacauucccguguacuugcacaaaagguucagugaaucagcacaguggaaaugcaguguguuccucugucugcuucugagagcgagcucagggcagaaaugcuccagaugaggcuggcucuguauuugucagagcagcggaggagguuuggugccguggugaucaucuuuucugccuugggauaaauguuagaguuucucuuuagaaagauucccuguaaaaggaggaauaaaccaaagcuguuacuucauucuugaggcuauuguuauguauuuuuauuauacugaagacuuauauugccuaauauuaaauugcagcuaagcuuauuguuggggaggucuucuuaaagaugggagaccccucuaccaugggagagccugagguagaaaauaaaacaauauaugaaauuauuuacugauagaauauaaauuuucagagugguuaauuuaaaaaaugcucuuguauauguuuuaaaauaguguuucacagacgauuauccaaaagauuugaaacuaauggugcauauuauuggcagacagggucuuuuuuuguuuuuuuguuuguaaaacaaauugcuuucaaaggaccuuuccaugcuuaauguguagcagagagacaaguuauuuggaaagguugggaauaggauauaaagaagaaaugagaucuuuaaaucuauuuuuuauuacccugggaaaaaugaauuuuaguagccaguauuuuuuguuuuccuucccaucuuagcuacugaauauuuguauaaccuaaguaaauccuucacauuaacauuguuauaaggaucuguaaguugacaugcaaacauggacagaccaucugaacaucucaaagccacgccucaucuagaucaggcaucuuuaugaaugagguaaguaggugcggaguuguugaggacaaauauggaagagauuguauuagagacaaacagacugguucgcaggaacuaacuaaucuucaaauauuguuucuuuccacuauuucauuuuuagcuuccaaagugagucauuugauuucuaguguuauaagaagaauugacguccauauuaggcagggauuacuuuugaaaacauuuuccaaaauugauuguaaccuuccuaaacucaaggauauugaacuggaauguguagaucucaucuggacucucuaguuuauaugaaaguuuuacgcccuuuucucucucucuuuuuuuuuuuucuauagcuuuucauggauacugcuccaacaaagguauucagaucauugacuacuuugcaguucuuuuauaugacuuuaaacuguagaauuuaaucuguuaguugucauucuugguuccguccuuuccuguuugcuggucuuaaucuuagguagcagauucaguuuucuguaacuguagagcagcauugguauguuuaugacuuaaguugaaauuugucuuuauaugaaagguuuuguugguuucugugauaguuaauacugaaaguaguuucugcgauauuucauuggauuaauaugaaugccagguuuugggugguagauauuuuuugguaauauucaguuuuucuuuuuaaauugaauuucacuuucauaggcucuuguggaaaggguacucacaaugaguuguuauaacuauaacagcuacuccuguuuuuuuuuuuuuguggucauuuaguucuuucuagacauuuauuugacuaauagacagauuuauauccuauuuacugaauuuggcaagagggaaaugucaugaaaugcuaacuugggaaacagggaagugcuucuauauucuuuuuuuaauuuaaaaaguauucuugccgggugcgguggcucacgccuguaaucccagcacuuuaggaggccgaggcggguggaucacgaggucaggagaucaagaccauccuggcuaacaugcugaaaccccaucacuacuaaaaauacaaaaaauuagccgggcgugguggcgggcaccuguagucccagauacucaggaggcugaggcaggagaauggcgugaaccccugggggcagagccugcagugagcugagauugcgccacuucacuccacccugggugacagagugagacuccaucucaaaaaauaaauaaauaaauaaaugaaguauucuuauucacguugacuuucaaaugccucagauacgggcaguaagcaaaaaacaaaucugaauggguguguguguguguguguguguaucuauauaucuuuccaauuuaaaacaauucuaacuuuaaucucuuggucuuuuauacagcuucuuuaaucucagcauuauuuauauucuagaggagcaguucucuuagagaaugcuucauucaccaguuggcucaaaaauuugguccuauucauugucuuugagucugaaaagcugaagaagcuaggcuggauaaauuaauucuaguugcauaagaucacauaucaacuucauuucucagguaguucaguuuuauaccauuaaaauuugguuggcaguguacuuuuuacaaaauaaaaacaucuuguuccugaugucugugauauuuauuguucuuucaaguucucauuugaaaguaacauuacuuucuuggcacugcuuugcaauuuaugacauugaucuuuuuauauccaauccauaaugcaauacuaucauuacaaauucugaauucugcaaagccuucucucaauuuuaggaccaucucagcugaaucauucuuugcguuuugcucauuuauuaucuauauuuauaugaauggugcuauggaauuaauuaauguauccauucaacaaguauuuauugaguaacuacuugaauugggccaaguguuauuaaagaauggaggggcaagggaugugaagauuuauaacaugccccuuuucccugaagacugagaaagaauacacucuuaaaucaucaucugaaugaagacagguaaugaaagaauuagucauuauguaguuuugcucuuuucaucauuuaaauagcaucaguuugaaagaauuguguguuggaaaugucacucgaucauuccuauacaaaaugaauaauuuggucugggcgcaguggcucacgucuguaaucccagcacuuuggggaugccauggcagguggauuacuggaggacaggaauucaaggccagccuggucaacauggugauaccccaucucuacuaaaaauacaaaauuagccaggcguguuggcaugcaccuguaaucucagcuacucaggaggcugaggcaggagaaucacuugaaccagagguugcagugagcagagauugugccacugcacuccagccugggugaaagagugagacuccaucucaaaaauauauauauaugaauaauuuuuccaaugucuggugaaaaucugucuugugugucuuuucgugugugugugugugugugugugugugugugugucuguguuuuaaccuuuaaacaacagggaauagugucauuuugguauguaacugaucauauauaaguauauguuaauaauucaccgaaaacccuaucucuauuaaaauacaucuaaaggaaaaggucuacauuucaauuaguucuauaucucuaauuuggaucucuugcuaucccagaggauauaauuuaaaauaagauuucuuguuuauucucgguaagaaguaauuacagagcaccuuuaagcugaguauugcuucuuaaauugaaggcacuaaagauaaagauugcuaaauauuucgggaacuagauuuaacugugugacuugaacugaaaagcauucuaauuuuccauucuuuuaugggugcuggggaagaacugcuuugacaugaauguauaauagaauuaaaaugucggucuuaaauuuuggggaguuguucucaguuugcucuuggaauuuauuauuguaauacugucauuagauaguuuguuggaagcagcuaauacgugaaagugaagcaucuuaauaugcaucucuuuucuuucugacaaugaacugucaaaaaagcuuugaguuuaucuaacaaacacagcugaggcugggauuuuaacuccacuauuaauauauucuaauuuuaaacuacuguaacugaaagggcauacagcacuaauucaauccagacauguuugagugcguuugauagucucauccuuguaauagcugcugaaaaagaugugguagagauuucagacuggaccacugacgucugggaauugacacuagcacacagacugggucaggcaagguacaaccuggugccgccagcuguuuugcauggaagaccuuaucuguaaaacucauagagagucaaacaagaugugugccucugaaugaaugggauccuuggaaaggaguuuuaaaauagguuuuaaagguuuucuauuuuccccuccagaaccagcaggaacuguucuggaucacagcaacacgagucugcuuucugcuucuuggcagagccguugccccugugguggcaguuguguggugggugauagcugggagugggaaucgacucuacuccagcaugagggagagauucuuuuccaacuuccccagacccgucccacauugcucguguauucugccacuaacaagaaugaagacaucacauuggccgggcgcgguggcucacgccuguaaucccagcacuuugggaggccaaggcggguggaucacgaggucaggagaucgagaccauccuggcuaacacagggaaaccccgucucuacuaaaaaugcaaaaaaaaauuagccaggcgugguggcaggcaccuguagucccagcuacucaggcggcugaggcaggagaauggcgugaacccuggaagcggagcuugcagugagccgagauggcaccacugcacuccagccugggcgacagagcgagacucuaucuuaaaaaaaaaaaaaaaaaaaaaaaaagacaucacguuuaaccugaagugaauaacagcuuugcuccaaaaugaaaaaaaaaaaaaauuuaaugaaaucugucuuacugaggaaggcaggaaaaggaagaaauaccucaaagcaucccuuauccaugggggccuuuucagguagcauugaucagauuuuuagagcuuaaauuuauggauucagaagacaaccauuuccugccacagugcuaauagaauuuuuucuuaaugugagaguuuugggaauuuccaaaauaaagauaugugggauauucugaaagcuaaccauuaaauucccaauaaacucagauuuuuuuuuguuuuuuuuaaucaaagcucuggauuaggaauucuuauuuaaauuuuuuuuuuuuuaaauuuuuuugagacacagucuugcucucuuggccaagcuggaaugcagugacacaaucauagcagccuccauuuccugugcucgugauccucccaccucagcuuccugaguagcugagacuacaggugcacaccaccaugcccagcuaauuuuuaaaaaaauuauuaguaggccaggcacgguggcucacgccuguaaucccagcacuuugggaggcugaggcaggcaaaucaucugagaucgagaguucgagaccagucugaccaacauggagaaaccccaucucuacuaaaaauacaaaauuagccgggcgugguggcgugugccuguaaucccagcuccuugggaggcugaggcaggagaaucgcuugaacccgggagguagagguugcguugagcugagaucacaccauugcacuccagccugggcaacaagugugaaacaccaucuccagaaacacacacacacacacacacacacacacacacacacacacacacacacacaaacuuuuaguagagaugagaucucauucuguugcccaggcuggucuagaacuccugggcucaagcuguccuccugcccaggcuucccaaaguacuuggauuacaagcaugagcacugcaccuggcuggaacucuuaguuuaaaaugauuucagagaacaaauaauauucuuuuuuuuuuuuuuuuuuuuuuuuuugagauggagucuugcccuguuccccaggcuggagugcaguugugcgaucuuggcucacugcagccucugccuccuggguucaagugauucuccugccucagccucccgaguagcugggacuacaggcacacaucaccacacccgcuuauuuuuguauuuuuaguugaaaugggguuuugccauguaggccaggcuggucucgaacuucugaccucaggugaucugcccaccugagccucccaaagugcugggauuacaggcaugagccaccauucccgggcagcaaauauuauuuuaauauagagacuuaugaauauaaauauuaaguuuuguuguuuaaugcuauaaaagcuauuuuuuagaaaaagccaauuuuuuguguaccuguuacacaucccauugaacauaacaccaucaugcagugcugcuucguuguaacuauuugucuuugaaaaaaacaauuuuuuuuuugaggcaaaauuucgcucuuguugcacaggcuggagugcaguggcuuaaucuuggcucgcugcaaccuccaccucccggguucaaacgauucuccagccucagccucccuaagugcugagauuacaggcaugagccccugccccuggcccuuaaaauauuuuacuaaaacuaaguaggcauauauaugucugcagucagugucuugcuuugcauuccccagaacagaugcugagucaaggauccagugaaaguacuuccuuugggaaaugaucccaggaagcacucacaggggaguggggaagugagaugguaaggaaaggcaagccacaaauagcucauuaucaggcagguuacuacugugggaauggaguuagaggccgcaggggaacccugggagccaguauaggacacacgcugcagaguuuuccucacugaggguugagggcgugggauauuuauaugccagucacuuaccccugcuugugucuugcuggggaguggggaaugaucauuuucaaguccuaugacaguaggcaaaauggacucuuuaggccagagaaagcccugaaagaaauagugguacaauuggaaauuggaaauugugcugaaaaugggaaggggauauggcugguucuuaacagcgccugcugcauuccauuacguuauuguuauuuuuuuuuuccucugugcucuuagugcuauuauuguaaguucuuagcugguucccucucaaccauuauccuuaaauugaauguguuauugucacuauguuguguccugguagggcauuuuugacagugaauguugagaaagcauaugcaugugacagggcggauuuguuagaagcaguggaaaggugaguacuaaacuggguguuuaaaaugcaagcuucagcugggcacaguggcucacaccuguaaucccagcacuuugggaggcagaggcggguagaucaccugaggucaggaguucaagaccagccuggccaacauggugaaacccccucucuacuaaaauacaaaaaaaguagcugggcaugguggugcaugccuauaaucccagcuacuugagaggcugaggcaggagaaucgcuugaacccaggaggcugaaguugcagugagccaagaucgugccacuacacuccagccugggggacagagcaagacucugucccccuccugccccgccccccgcaaaaaaaaaggccaggugugguggcucaugccuguaaggcagguggauuacgugaggucgggaguuugagaccagccugaucaacauggagaaacccugucucuacuaaaaauacaaaauuagccgggcgugguggcgcaugccuguaaucccagcuacucgggaggcugaggcaggagaaucgcuugaucccgggaggcggagguuguggugagccaagauggcaccauugcacuccagccugggcaacaagagggaaacucugucucaaaauaauaauaauaauaauaauaauaauaauaauaauaauaauaauaauaauaaaugcaagcuucacgaggccuuuucaaggaaauguuuaaggaaaccagguaaagauaaguaugcaauuaaggacuuggaaguugugugauuuuuaugaaaggcuuuauaaacaucacuguagcuuggaaguuugacuaacaguuguguaacuagaauuauggccagugacagguccugacuucggugaauguggagugacuggaagagcugagccauugccaguguagcaugccaggaauggaucuccacagagacuguggauuccguucaaguuccauuuccaggaacuccucguccuuagcuagacagagugugugccuguaaagucaaccacuuuaagucuuuuauuucgaauaagggaagauaacaaauacuuuggcacucuugggaauguuucaagguggaucuacugguuuaauuguuccaggguuucuaaucugugugucacaugcuuacacgaagcuaggcaauagggagaucacagguuaccgcaugugaugucacucagugcuguuuacuaucgguaccuuuuuggaugcuuuccucucuuuauuaaaaucuugcgcagugucuuuucauuuuuucuucagagguaauucagucuguucuuacuggaggggaaaaauaagucauagugcuaaucuuguaagaaguggaauuuaacaugcucaagcuuucacaugggaucaagauucaauaauaaaagccuugacguuggaagcuuaauaguuuuagaaauaauuuuucugcaguuucucgaaugucagugggcagcauuuagaauguguuugacuaaguagugcuggucuuccuccccuuuaagccugcacuugugguacagccagguuucuaguuucaugacgcauuuaucauuggccuaugccuggcccuugguuaggcuuccuguauuuuucaaauguggccaacuagacagcauuauaccucuucaccuagaguugcuuucuuuuuuuuaaguuuuucauuuuauuuuguuuauuuuuuaauagguaauauaugcauguagguucaaaauucaaaagauaacaaaagaguaaacaacauagacuaaggcacuuuccuguuuucccuccccauaaucugucaauauuacuaaccucuugugugucuuaccagagauguuuuguguauuuguguguguguguguguguguguguguguguguguguccguuucuaucaccucaaaugacaccacauuauucucauuguucugcaucuuguuuuuuuucacugcucuuagguuacucaaugagcacagaauuggaacaaagggagauggaagaucuuaacggaugguuaagcuucugguuuccauccaguagcuggcuggaagcugaugguuucaagcuucucuaagucgagauguggugauaauagccuugguguaguuacugucucuucagugcuaaggcuccugcuaaaccugcgucucuccccagcccacaaauaaaguuucuaugauauaggugcucauuacuuuuaaaaaaagaacgcagagagagagaaaaaaaaucaucagugauccuaauagcaaagaauagcuaauuccauuaguuagguuagacuugguuguguggugauauaguuuggcuguguccccacccaaaucucaugaauuguagcucccacauucccauguguagugggagggacgcuggugagagguaauugaaucaugggggcaggucuuuccugugcuguucucaugauagugaauaagucucaugagaucugaugguuuuauaaaggggaguuucccugcacaaguucucuucucuugucugcugcugugugagauguucugccaugaucaugaggccuucccagccacguggaacucugagucuguuaaaccucuuuuguaaauugcccaguuucggggauguccuuaucagcagcgugaaaacggacuaacauaugugguaauaaaaaauaagacccccaaaucucagcagcugaaaauacagacguaauucuuuuuugcagaggugcugugcuucagcagggaacugugcuuguugugacugcuuggggacaugggcugaugagcagcaucuucucaguauugcuggucccugugcagagggaaaagagcuguggaaggucuggaauuaacauuuagaugccuuuuuccacucauagcucacaggccagaaguaaucaaaugguuccauccaacaggccagaaauauuuggugaacagcacuaaugacuaccacaguuaguuuuuguuuuguuuuguuuuuguuuuuguuuuuguuuuugagacugagucucgcucugucguccaggcuggagugcaguggcgcgauccuggcucacugaaagcuccgccuccuggguucacgccauucuccugccucagccuccugaguagcugggguuacaggcacccaccaccaugcccagcuaauuuuuuguauuuuuaguggagaugggauuucacuguguuagccaggauggucucgaucuccugaccuugugaucagcccaccucggccucccaauuuuuuuuuuuuuuuuuuuuucgagacagcgucuugcucugucgcccaggcuggagugcaguggugcgcccucagcucacugcaaacccccaccuccuggguucaagugauucuccugccucagcuucccgaguagcugggacugcaggcgccugccaccacacccggcuaauuuuuguaguuuuaguagaugggguuucaccauguugcccaggcuggucucaaacuccugaccucaagugaucugccgccucggccucccaaagugcuggguuuacuacaggugugccacgcccggcccuuuuguaaguuuuuuuuuugagauggagucucuuucugucaccaggcuggagugcaguggugcaaucuuggcucacugcaaccucugccucccggguucaagcaauucuccugccucagccucccaaguagcugggacuacaggcgcacaccaccaugcccaacuaauuuuucuauuuuuaguagagacggaguuucaccauguuggccaggauggucucaaucucuugaccucaugauccgccugccuuggccucacaaagugcugggauuacaggugugagccaccacaccuggccccacaguuagguuuuuagauuguucagagcauguuuagauacacagauaugucuauagagaaauacacuuuuuuuuuugagagggagucuugcuaugucgcauauacuuucacaucaacaagauaaauauuccaaguacuaucauaucauuaguuucuuccuauuucauauaauguaguggaauauuuuauugucauaaacacuucuaaacauggauaucuuuuuuuaguggaugcauacuguuccauuauaugguugcauaauaaucuguuuccuuauguauccucuacugagaaaaauguacauaaauucauuugcauaacauuggguagagaauuuuaggaguuguggacaccaucccuagccaagccauggauugcuguuauaguuuauagguuauaaacacaaacgcuaggccgggugcgguggcucacaccuguaaucccagcacuuugggaagcugaggcagguggaucacuugaggucaggaguuugagaccagccuggccaauaugguaaaacucugucucuacuaaaaauacaaaaauuagccgggcuugguggcgcacaccuguuaucccagcugcucaggaggcugaggccggagaaucgcucgaacucaggagguggagguugcagugagccaagaucgcaccauugcacuccagccugggcaacagaguuagaccccaucucaaaaaaaaaaaccacaagcucuauuuagaauacucucuccuuaucccauuaaucucccucacaaaaguguaauaacuuuuuacacuugauauuuugguagguaaauaaauucacaugguucugagaauaaguauaaagugaagagccucucaucagccccuccuugcccucaucuguccaguucuucuuaccccugcuaucccucacagauuuuaauuucucauuucccuccagaauuuuuuuaaaaaauguauuugcauaaaauauauauauauauauaauuuuuuugguagagaugggcucuuguuauguugugcaggcuggucucaaacuucuggccucaagugauucucccaccucggccuaccaaagugcugggauuacaggcgagagccaucaugcucagccaagauucuuuaaaaaguuauuauuuuacccuuuuuauuuuggaauaaaauuggauuuauagaaaaguuacauuuagaaauaacggccagguaugguggcucaugccuguaaucccagcacuuugggaugccaagguggauggaucacgaggucaagagauugagagcauccuggccaacguggugaaaccccguuucuacugaaaauacaaaaauuaguugggugugguggcaugcgccuguagucccagcuacuugggagggugaggcaggagaaucgcuugaaccugggagguggaaguugcagugagcugcgccacugcacuccagccuggugacaaagugagaauccgucucaaaaaaaaaagaaaacaaaagaaaaguuacagaaauaauacagagagcucacccgguuuccugaaaugaaagcaucuuauguugccguagcauguuuaucaccacuaagaagcuaacaucauugugaauuauuaacuaaacuucagauuuuauuuggauuuccccagguuuuucauuaguaucuuuguucuguucaggauacaguccaggacacuacauugcauuaaacagauucucuuugaauugagagauagcaugugcuccaugugguucugcauuuaguguucucaacugaugaugucauaauucauugauuucaaaauccaauggaauguaacuauuauuuuugaguacuucuucuccuuuuuuuuuuuuuaaacggaguuucacucuuguugcccaggcuggagugcaauggcgagaucucggcucacugcaaccuccgccuccuggguucaagugauucuccugccucagcuucccgaguagcugggauuacaggcacccaucaugaugccuggcuaauuuuuuguauuuuuaauagagaugggguuuugccauguuggccaaguuggucuugaacuccugaccucaggugauccgcccaccuuggccucccaaagugcugggauuacaggugugagccaccacacccggcucuaaguacuucuaagaaaggaaaaaugcugccaauuauaauuguaaguuacuaauuauaagauacggcauaauuucagagauguucaaaugugagaaaaguacauuuuagauuuaauggaauaugauacaucuuggaaagauuucaacuuuauuucacagaauuuucucauucuuuuuguaccuacauagaauuucacuuuauaauauacaaaagaucuuuaagcaagcccuuauugauacucauguggauuguuuucugucuuuagguauuaaaaugcuguauucaauaauuugggacauauaugucauuucacauauauacagauguguaucagggugacauuccaaaagugcacugcugaguuagagguauauguauuuguaauuuugauggaagcuuuaccaauuuacagucccacuagcaauguaugagaauaguuuuuuuuaaugacuucacaaauaggccgggcacaguggcucacaccuauaaucccagcacuuugggaggccgaggcagguggaucacaaggucaggaguucaaaaccagccuggccaagauggugaaacccugucucuacugaaaauacaaaaauuagcuggguguaguggcaggcgccuguaaucccagcuacuggggaggcugaggcaggcgaaugacaugaacccaggagguggagcuugcaaugagccaagaucgugccacugcacuccagccugggugacagagcgagacuccaucucaaaaaaacaaaaaacaaacaaaaaacacuucacaaauaaaguagguuaccaaacuuuuagauuuuugccaaucuaauguuuggaaaauuauagucucaauguaguuuucauuuguauuucucuuaugaguauagguugaguuucugaaaacuggccauaaauauucuuugcacauuuuucuauugggcuguuuccaauuuuuaugcauuaggcucuuucaguauuagugacauuauuaucugugaugaauuacaaauguauuuucuuuuugucguuuaccuuuugauuugcuuauacuugauuagugcuuuguguuugccacacaaaguuuauagcugacucuguuaaucuuuucuauuauggcuucgggauuuuaagucauaauuguacucaagaaauuuauuaaggaguuccucuauguuuucuuccauuucucccauccuagccuuuaugcuauuguccuuaugaauuuuacuuuuacauauauuauaaauccuguuacuuuuguuaauuuugucaaaauaaucaucuuuuaaagcaacuuaaaugaggacaguaaacucuuaaacauuucuccauguaguaguuagcauuucuagggccauucauuccauuguauaaauacagauuuccaacuggcauuuuccuucuaccuggaagauaucuuuuaacauuuuuuauaguguagaucugcuagugauaaacucuuucaucuucugaaugucuaaaaaugucuucauugugccuuuguuuuugaagauuuugcuuaauguugaacucuagguugacauuuuucauuuuuuuucuuugaauacuuuaaagauguuucucuucugucuuuuuuuuuuuuuuucuuuuuuggaaacaaggucuuucuuuguuacccaggcuggagcgcaaugacacaaucucggcucacugcaaccuccgccuccuggguucaagcguuucuccugccucagccuccugaguagcugggaucacaggcgcaugccaccaugcucggcuaauuuuuguauuuuuaguagagacgggguuucaccauguuggccaggcucaucucgaacuccugaccucaggugauccaccugccucggccucccaaaguaccgggauuacaggcgugagccacugcgccuggcccucuccugucuuaucacuugaauugguagcaacaauaaaucugauagccuucuuugcuucccuguguguaauauuucuuuuuucucuggcugcuuuuaagauuuucucuuguuggcuuugaacaguuuaugaugugcauuggugugguuuucuuuauguuucgugugcuugagauugguugaacuucuuggaucugugugcuuacagaauucaucaguuuagaaagcucucagccauuacuuauguaaauauuuuuucugccuccuucuccuuaacauauaauuaucugcuuauuagaccauuuuauguuguuguauagcucacucuuacacuuuuuuuuuuuuuuuuaaagauagagaaggucuccaucugccguccaggcuggaguguaguggcgugaucauagcccacugcagccuugaccuccuggauucaagugauccgcccaccucagccuccuguagcugggacuacaggcacaugccacuacucuuggcuaauuuuuguauuuuuuguagagacaggauuuuacaaucuuauccaggcuggucuccaacuuccgggcccaagcaauccccccuccuuggccuccuaaaaugcugggauuguaggagugagccacuaugccugcccuucauuuuuuuguauuguuuucccuucucuuuucauuuguagaguuucuaaugcugugccuucagguucacuaaucuuuucuuaugucuuaucugccauuaguccuauccaguguauuuuucaucucauaauuguaguuuuuaucuucagaaaaguucaguuugggccauuuuuauaucuuucaugucuuuuuguguguuuuuuuuuuuuuuuugagauggagucuugcacugucucccagcaggcuggugugucguagcacaaucucggcucacuaugaccucugccucccggguucaagcaauucuccugucucagccuccugaguagcuggaacuacagguccgugccaccaugcccggcuaauuuuuauauuuuuaguagagacaggguuucaccauguuggccaggcuagucucaaacuccugaccucaugaucugccccccucagccucccaaagugcugggauuacagguaugagccaucaugcccagccuuuuuucuuuucuuuucuuuuuaaauaacagcucuaauucacauaucaugcaguucaccaacuuaaaauguguauuucaaugguguguuuguugaaaguuauauuuuauauaguauucaaaugucaauuauuuaacuuuaaauauuuuuaaagcuuuuuuaaauaaauggaguauuuguagaguuguguaccuguuaccaugaucugauuuuaauauauuuucauuauccccucaaaaaugcucauacccaauggcagcuauucccuuccccucaccucucccagccaggcgcaacuacgaaucuacuuucucucacuacuuauuuccuauuuugaauauuucauauaaaugagaucguacuauuuguguucuuuuaugccugguuucuuuucauacagcauguuugugagguccaccuauuuuauaguauguaucaguacguauuccauuuuauggcugaauauugcauuguaugacgguaucauauuuuguuuaccaguugaugcacauucaaguuguuucuccuuuuaggcuauuaugaauagugcuguuaagaacauucacguacaaguuuuuauguggguguguauagguagaugccuaucuuaccgauauauggaauggaguuauaguaacuuguagcgucuuucucugcugacuccaacuguaugucaguucugagucuguuuugguugauuauuuucuuuacgugucaugcuuuucugcuucguuguaugccuggcagucuuugacuggaugcugaauuuuacuucauggguguuaaauauuuucguauuguuauaaaccuuaaacuuucagagacguaguuaaguuacuuaaacagucugauacuuucaggucuugcuuuuaugauuuguuaggcagaccuggaccaaugcuuaguugagggcuaauuuuucuuuuucuuuuugagacggaaucucgcucucccuccaggcugaagugcaguggugugaucucagcucacugcaaccucugccucccggguucaagaaauucuucugccucagccuccugaguaagcugggacuacaggcacgugccaccacacccagcuaauuuuuguauuuuaguagagacgggguuucaccaucuuggccaggauggucucugucucuugaccucgugauccgucugccucagacagccaaagugcugggauuacaggugugagccaccgcgcccagccaagggcuaauuauuauuuauuucccgaguacuccguucagugccccaugaugacuuaggagugcugagaacaagcacucaugccagccuguacgauucugcuguaauucuuucagaugguucucuccugggcuuuuuuuuuuuuuuuuuuuuuuuugagacagccuugcucuguugcccaggcuggagugcaguggcgcaaucuccgcucacugcaaccucugccucccagguucaagugauucucauuccucagccuccuggguagcugggauuacaggcaugcaucaccacacccugccaauuuuuauguuuucaguaaagaggggauuuugacauguugccuaggcuggucuuaaacuccuggccucaaaugauccaccugccuuggccucccaaagugcugagauuacaggugugcaccaacugcggccacccucuccugggucuuuaguaguuuucucacuugcauguucuauguucuguuggauucuguuggauacuuuggacccuuugcaaaucucuaggguucucuauucugugcagcuuucuucucuuugguuacucuguccugggagcucuugcugccuugauuuucccuggacucagcuccaugucguuaauucagggcaucugccagguucugccucaguuuacucuuugugcagcagcgguaagccaaagcaguugcagggcucaccuuuuuguuuccugugucucagggauugccuguguccuucauugcuugauauccagucuugaaaaacguauaauguauuuugguuuuuauaauuuaaguuaguugcuuuuuccagaggaauaguaaaucugguuccugucgcuccaucuugucuaguauuggaaaucuuauguuuuguuacagauuuuuuguuuuuauuuucuuacgucuaaauauuuucuucauuuuaaguuuacucaguugugaggugagaguuacuuuaucuuuucagauggcuaccuaauaccauuuauuuacaugacaucugguuuaucaucuuuaucauguauuacauuccugaauguguucgggucuaucuuaggacuucucuugacaucucuucuuuguguaugucuguuggaugccagcaacugucuguuuuaguaacagaggccuuuuaauaucuuuacauauccaggugugcuaucccuuuuuagagcuuuuuuccccucccagcuuucucccaaacucuucuuguuuguucuuccuuauuuuuccauauuaacuuuaggauccacuugccuuccacgaagaaacaaaaaauccuguuaauuauuuauaugaauuaacuuaggcagaaaaaaauauuuauaaugacuugucuguucacaaacaugguauggcuugcuuuuuuuuuuuuuuuuuugagaccaagucuugcucugucgcccguucuggagugcaguggugccaucucagcucacugcaaccucuuccuccuggguucaagaaauucuccugccucagucucccgaccagcugguacuacaggugugcaccacuacgcccagcuaauuuuuguauuuuuaguagagacgggguuucaccaucuuggccaggauggucucuaucucuugaccucgugauccgccugccuuggccucccaaagugcugggauuacaggcgugagccaccacaccuggcuauaguauggcuuuuugacugcugaagucuucuuuugggucccucaguaauauauuaaaauuucauaccugucuugcacauuacauguuaaacuuuuucuuagauauuuaggaacuacaaaugggguuuuuaaauucuauuuuauuucacauaugaaccauuuucugagcaguuaacaacucuuacggcaaacauuuuaauuuuauuuaacuuugacuccucaauguuuagaaauuaaagacugaggaguuauuguaaccuccauaauacuacauuuacauuguagaugaauaccaaauggcuuuuuuuaaauuuaauaaaauuauaggaauuaaccuuucugaucuuguagguauuuuaucuuauuauagcccuuauaaauaagacuuuauuaauguccuuguuuagcaaccuguuuuuuuguuuuuguuuuuugagacaaagucucacucuguugcucaagcuggacugcaguggcgcgaucuuggcucaaugcaaccuccaccucccagguucaagugauucuccugccucagccuccugaguagcugggacuacaggcacccaccaccaugcugacuaauuuuucuauuuuuaguagagacaggguuucacuauguuggccaggcuggucuugaacuccugaccuugugauccacccaccucggccucccaaauugcugggauuacaggcgugagccgcugugccuggccagcaaccuguuuuugaagaauaaguuacaaaacugauggugaacauauuucagugaauagauuucuuugcucgauaagugcauaggaauuugcuugagaagcaaaaacagcuuuuuggcugggugcggugguucacaccuguaaucccagcacucugccaggcagaggcgaguggaucacuugaguccgggaauucaagaccagccugggcaacauagugagaccgugucucuacaaaaaauacaacaauuagcugggugugguggcaugugccaguagucccagcaaugugggagacugaugaggugggaucgcuugagccugggagucaaggcugcagugagcugugauuuuuccacuguacuccagccugggcaaaagagugagacccugucuuagaaaacaaaaaaacccuuaagguuuuacauugcugaaagaaauuaaagacaggccgggcgcuguggcucaugccuguaaucccagcacuuugggaggccgaggcgggcagaucacgaggucaggagauggagaccauccuggcuaacacggugaaaccccaucucuacuaaaaauacaaaaaauuagccgggcgaguuggugggcgccuguagucccagcuacucggaaggcugagucaggagaauggcgugaacccgggaggcggagcuugcagugagccuagaucgcgccacugcacuccagccugggccacagagcaagacuccgucucaaaaaaaaaaagaaauuaaagacacaaauaaauggaaagacaucuuguugcuugugaaucggaagacuuaauauuguuaaaauguuaauaacuaccuaaagcuaucugcagauugaaugcagucccuaucaaaauccuaauggcauuuugugcagacuuagaaaaauaauccuaaaauuuauauggaaccucaaaggauauugaauauccaaaacaagcuugaaaaggggaaagaaaaaaaaagcuagaggcuucaauuccugauuucagaauauauuacaaagccacaguaaucaaagcaguaugauacuggcaugaggacagaccaauggaauagaguaaacagcccagaaauaaacccuuauguauaugguuaaaugaucuuugacaaagauaccaagaauuugugucuucaacaaaugguuugggaaaacuggauguccaccugcaagagaaugagguuggacucuuaccuuacccuagauacaaaaauuaaugcaaaguaucuuaaagaccuaaacauaagaccagaaacuauaaaagucuuagacaaaagcauaggaaaaugccucaugacguuagauuugggaauaauuuauuggauaugauaccaaaagcacaggcagcauaagcagaaauagacaagugggauuacaucaaacuuugaaacuucugcucggcaaagaaaacagcagagugaaaagacaaccuagaauggaagcaaaccguaucucugauaaggggauagcacaaggggcuaauauauacaauauauacgcaacuccugcaacuuaacaaaugaaaacaaaccaauuaaaaaauacgcaaagggcuugaaucaacaguuuucuaaagaagauauacacaugaccaaugagcguaugaaaacugcuccacagccagagcuguggcaugcaccuguauguaggcccagcuacuugggaggcugagguggaaggaccacaugagcccaggaguuccaggccaggcugggcaaaagagaccccaucucuaaaaaagaaaaaagaugcucacugacacuaaucuuuagagaaaugcaaaucaaaacuacaccuuuuaggauggcugcugucaaaggaaaaaaaaaaaaaaccaggaaauaaauguuggcgaggauguggagaaauuggaagucuuguacacuuuuggugggaauguaaaaugcugcaguugcuauggaaaauaguauagagguuccucagaaaacuaaaaauugauccagcaaucccacugcugguuauaccaccaaaagaauugaaaacaggauugcccagugguacuuuuacacuuauguccaguccagcauuuuucacaagagccaagagguggaagccaccucaauauucaucaacagaugaauggaaaaagaaaaucugguauguaucuaacaguggaauauuauccagcuuuaaaaaagaaagaaauccugucauauacuacaacauggaugaagcuucagggcauuaugcuacguucaauaagcuugucacgaaaagacaaauacugcuugauuccauguauauaggguaucuaaaguagucagacuccuagagacagaaaguagaauggugguuuccaggaccuuugggggauagggaaaagaggaguuccuguucaguggauauagaguuucaguuuagcacggugaaaaacuuugagauguauugcgcagcaguguacauacaaguuaacauuauuauacugugcucuuaaaauggcuaagaugguaauuuuuauguuguuuguuuuugaccacaauuuaaaaacuuuuuuuuuuuuuuugagauggagucuugcucuguugcccaggcuggggugcaguggugcaaucucagcucacggcaagcucugccucccggguucacgccauucuccugccucagccuucugaguagcugggacuacaggcacccgccaccacgccugccuaauuuuuuuguauuuuuuuaguagagacaggguuucaccauguuaaccaggauggucucgaucuccugaccucaugauccaccugccugggucucccaaagugcugugauuacaggugugagccaccgugcccggccuaaaaacuuacgguuuuuaaaagcucgguguuacaucuauuucuauuugcagacuaaucuuaauauucuauuuguguagcuauucuuuccuaaauuacauuaggcuccugaagaucaagaguccagauuucaaagaauauuuuacuuggaccuuaagcaaauaagugcauacaccugacaaaugaaaagguuacuuuuaggaauggaauggaaauaugaaauuagaauuguuuaggaaaauuuaggcugugugauuaagcauaaacagaauucuugcauauucauucaaguuaaacaaaaaaccaaauauacuuacuagguguauuuuuuuuuuuuuuaagacggagucucacuuuguugcccaggcuggagugcaauggcgcaaucucagcucacugcagccuguaccucccagguucaaacaguucuccugccucagccuuccaaguagcugggauuacaggcgcaugccaccacgcccagcuaauuuuuuuuuguauuuuaguagagauaggguuucacuguguugcccaggcuggucuugaacuccugagcucaggcaaucuaccugccucggccucccaaagugcuaggauuacaggcaugagccacugcuccuggccaccaggguacuuuuaaucaaaauguuuaauacuuuaugaauuucauucuacagaaagauuuaacuccugcuuucuagugguauuuugucuaugauaacuauccaaaugauacuacaaaauuuaaaucuacuucauaguuacaagcuaaacaucacuuuguuauaaaauagauaauaaauauaauucaguauugacauuaaaauucccagauuuuuacugacuucuucuaaaaccgcccuuuuuauguaagaaaagguaguguuuuaaaaacuacaaauuuggcugggugcaauggcucacgucuguaaucccaacauuuugggacgaucacuugagcccaggaguccaagaccagucugguuaacauagcaagaccuugucuuagccaaaaauacaaaacuuagccagguaugguguugugucccuguggucccagcaacuugggaggcucaggugggagaaucgcuugagcccaggagguggaggccgcagugagccuugauuacgccacugcgcuccagccugggcgacagaugagcccuaucgcaaaaacaacaagaaaagcccuauaaauuuaaguacacuuccuauucuggauaaaacuaacucaaaauuuuaaugucaauuugggaaacuuagugagcuuuuugcccucaacaucaaaguauaagcaaauuucucuuaaaauccuuuggcuuccaguggaguugcugacaggcuaugcacagcagugggcugcugcagagagcugaauguuacugcuguggaaauguguuguuguaaaagccggcuuauaaguaaaagcagcacacuccuuugcugaaagcccugcguggguuaauagggggcuuucagugaacagcccacucccucuccugcguuuccacacaguucugcugcuuccugcccccuccccuggacccccagaguguuucuucuguaguauugcagcccccacaagaagcaaagcuuugaagggaauugaaacuuucuaugauguggguuucaggguuuuuuugguuuuccuuucuggaauagaaaaaaaaaauuaaaucuugaaagccauaucguauaaaguaggcagucuggaagucacuuaccugagccacuuaauuauuuuuccauaggcuuuccuugaaauaacacuaugauauaauaaugagaaauugugggggcggggcggggaguuggcuuccuuuaaaaaaauugcucuggggcacuuguugauauaugugcuccuucguauuuguugauucggaauacauuggcuacauauguucauauaucacccugucaucacaagcccugugcaggcuacuuacucuuccuuggugccgccucucccauucguaaaauaagggugcuaagaccuaugucaucagacuggugaaaggugaaggagaucacauguauaaagugccuagacuaagauguacuccauggagcccaaccucuguguacauauucacuuguuuaugaaacaggcauuagcugagugucuggugugagcucagcagugcagggccaaguguaucugcccaggggugcagugaugccuggugcugggaucaaggcucuuggcagcaaaggcccucaaggcagaaggaacacuauuugcuccuugcuuccguggaggccuuuugucugucaggaucccccuugucagaggcuacagauuagaaacugauagguuuauuuccuccgugugugcuguccauuguagugaccacuacccacauguggcaguggcuccuguauuagacagagcagauagagacuuucccuuucuugcagaaaguucuuuuggauggugauguuuuagguggugagagagcuuggccuagucacuguuuucucuuuuuuuuuguuguuuuuguuuucgagacagagucucacucuguugccuaggcuagagugcaguggugcaaucucuuuucacugcagccaccgcuuccuggguucaagcgauuguccugccucagccuccugaguagcuggaauuacaggcacacgccaacacgcccgguuaauuuuuguauuuuuaguagagacaggguuucgcgguguuggccaggcuagucucgaaauccugaccucaagugaucugcccaccucagccucccaaagugcugggauuacaggcaugagccaccgcgccuggccuguuuucucauuuuaaauccaguucauguuuuuuuaaaguagugggguugauagaauauagggaauggcagauaaucuauuaaagcuaacuuaggcccuauuuccaugaauuuuccuuugugccaauuuuaggacuugaagagccacuuuuuaaaauuuuuaaaauauggacugggcaugguggcucacaccuguaaucccagcacuuugggaggcugaggccagaagauugcuugagcccauccugagcaacauggcaagaccccaucuccacaaaaaaauuuaaaaauuagcugagugugguggugcacaccuguggucccagcuacucagaaggcugaggugggaggaucgccugagcccaguaggucaaggcugcagugaguugugauuacacuacugcacuacagccugggugacagugagacccugucuauaaaauaaaauuauuuaaguaaacgucuuuugcagacugaagaaggauacaauuacuauuucaagaaucuuuaaaagaauuuuucuacuuaaccacauuuaucuuuucugguaggucuuuuaaaguugcaaugucauuuacugucaacagucuguaacagauacuaaggucaagauaauucucaauuauauucuuuacagaauacuucauuaauucuguagccuuuucauggaucuguaucaguuaagaguuuuuggguggccuucccucccccaccccagguuuuaaaaaaaucaaguguaauuugcauacaguaaaaugcauggauuuauguguaguuugaauuuuagcaaguguacaacuacgcuaaaguucccugggucuuuccugucaucccacuaccccaagcaucugcugucugguuucugucacuauagauuaguuuuaccugcucuugaacuugaugcauauggaaucauaaaacaaacucuugugucugucuccuuuuguguaucaguacuucauuccuuuguuacugcugagcgguguucccuuguaugaauauaugcggucuauccauugucuuauugauguacauuuggguugcuuucaguuuuuagcuuuuauaaagcugcagaaauauucaucugcaaaucuuuuuguagacacacauacuaauuugccuuagauauauacuuaggaguagaaugucugggucauagggaaagccugaguaacuuuguaagaaacugcucaauuuugccagugucuacauaccauuuuacauuccauuagcaauguaugaauucuaauugcacuacaucuucuccaacaauugguguugucauuucuaauuuuagccauuuuaaugggugugaagugguauuucauugugguuuuaauuugcauuucccugauacugaaugcuuuuuucaugggcuuauaggccauuccuguaucugcuuuugugaaauguauucaaaacuuuugcccugguucccauuuuuaaaacuucaauauguaccuuacaaugagaacacagggacacagggagggaaacaucacccacuggggccugucuggggguugggggcaaggggagggaaagcauuaggacaaauaccuaaugcauguggggcuuaaaaccuagaugacggguugaugggugcagcaaaccaccaugccacauguauacacguucugcacauauaucccagaacuuaaaguuaaaaaaaaaaaaagugccuuaaucccuuccacaccauuuucuuuaaauaaacaacaacagugcaauuggcaugacaaugcauuuuaaaucucucugagaaguuguuuucuaaagaaagaauuacuuauuaauauguugaguggccuagaauugugaauguccuaaauaauguuaggaaggauuugaaauaucauuggagauaaaauauuaugaauaauuuugcuuccgauaaggcaauuauguauucaaaauacucauugaaguaagucuuggccaggcgugguggcuuaugcuuguaaucccagcacuuugggaggccgaggcagguggaucaccugaggucaggaguucgagaccagccugaccaacacggugaaacccugccucuacuaaaaagacaaaaaaauuggccaggcauuguggaacgcaccuguaaucccagcuacuugggaggcugaggcaggagaauugcuugaaccugggaggcagagguugcagugagccaagauugugccacugcacuacagccugggcgacaaagcgggacuccgucacaaaaaauaaauaaauaaaauaaagucuguuuuauuaauugccaagaaauuugaaaugauauagacacuuacuuaucuuuuuuccccuuugaaaugcuuauuuagauggaaaaauuagaauguaaccuaucagaguucuuggcuuauccuagaagaauaucuuaucugcugaaagugaaugcuuucuuccucugugccuucucuucucugggucaggagucugacuuucuugacuaugauccaaauguuuuagggcauauuagugauaccauauguaaucuaauucuuuguaccauacugcuggaaacggaccugagccaaucuggucauccacaccccuuaggacuuuuugauagguuacagucacaaccaaaaagacuugagguagauggaguuuagcugcuuccccacaacacugcuaccaaguuauaauaaaagcuagccucagaugaaaaagucugccacucaacagucguucauucaaugcauauuuauuagcaagcaggcacaaaacagaugauucguccuguccugaaagcuuagcucuugcauuuuguggguacucugaccccuuuuaugaaaagcuuacuugaagcacagguauaggguuugucaugcuuauaguugguuccagucaaucagaaauccucacaaccgccaggcgcgguggcucaugccuguaaucccaacacuuugggaggccgaggcaggcggaucacgaggucaggagaucgagaccauccuggcuaacaugcugaaaccccgucucuacuaaaaauacaaaaaauuagcugggcauggugguagacgccuguagucccagcuacuuggaaggcugaggcaggagaauggugugaacccgggaggcggagcuugcagggagccuagaucgcgccacugcacuccagccugggcgacagagcgagacuccgucucaaaaaaaaauaaaaauaaaaaauaagaaauccucacaaccaggccagggcccuuggcucacgcuuguagucccagcacuuugggaggcugaggcgggcagaucacuugaggucgggauuuccagaccagccugaccaauaugugaaacccgguuucuacuaaaaaugcaaaaacuagccaggcgugguggugcgcaccuguagucccagcuacucuugagacugaggcaggagaaucgcuugaacccggaagguggagguugcaguaagccgagaucacaccauugcacuccagccugggcuacagagugagacuuagucucaauaauaauaauaauaauaauaauaauaauaauaauaauaauaaauaaauacaaccaguagccggaggguggcgccgguuuacgcauccagacugacauuucaaacacuaucccugaagacagucucguuagauuccucuuaucuguucaugcaaaugugggguguauccauaaaauauuuuagacaaaucugcauauguggauagucacuaauuucaccaaugagagcccauuucuuacagggauuauucugaugaacaugccacuaauuuuaccaauaaaaauauuuuugaugcccaguauuugaauuauaaauuuuccagagguaugcguaacagaagagcuacuguauuauuucuggaaugugacucccugcuuuaauaauggccauccgucucuggaguguaaguuucugauuagagcaacugccaccagaucugcccgaucggcucccuguuguagcuuaaaccaaucauauauguuuuauccuugucccugcaguuaaaguaaauaaacaacccaggcccauuauauaaaauuaguaagaggaauucaucuggauaguccauucucuauccugaucaauuuaauuaguaaaucugguaaaagucucagaugagaguuuaauuauacagcauccagugacacaggaaacuaaggucuugaacucugauuuugcuuuuguguuguuugaaauguuuguuccucagugccauaaagaaauagcacuugaacauacauuuaauuuuuuuaguaaggccuuuuuuacuuccugcagaaaggguacacucgccagcaguuuugucacgaaaguacaccaaacaaaggagacagggucauuuauaacuugacgcauccacccuacugcuguguccaguuuccauugacuggaaccguaccuuacauucuguauuugucccaguugacuagcaacuuagaacuuuuuaaaagaggcagagguagaguggaacaaaggaaggaggaaguaacuugugaaaugcugagaaagguaaaaacacuuuaaagaggaacaggcuaugaccuaaugcuugcuuggaccaguauaagcaugccagggcaaauauuuaggcuaaauugugggagcuaagaacauaaaguauauugauuuuuuuauuaugguuagcagauauuuaagaauguuagcauaggucuuuggauaaauuuugcuucuaagaaaaguuacuauuuauuccuaauuggacggggaggaaagucuuugaagaggaaccucuacuuuacuuuuuacagugucacauugacagcaugugggacgggggcuggagagguuuuuuccagugacuuaaguuucagggcccuuugucguaaaacaggaggagaagcagagagcuagcugauggagccgucccuugguucucaccaugaagcgcacugggagucagcuuugugucuccagcccagggcugcaggggauaaacuaggauaaggaaggaugaugaugaaaggcaacuagcuggaguuguuaucgcaucuuuccauuucagagcacuagcuaccaaugcuguauuuaaccuuauaucugugcugggacgguggaucuuguccuggcaggaaauagcuguuguuugaccacacugaacagggaugcagaggacaccaagguuaagggggacauaacugugaaagaugaaaggcuuccuccucauccuucccucacuccccagaggaauauauuuucacuuauggacuaacaccaacacguucaaacccaccuaauacucaaaaaguaaauacuuccuucccugcccccaaauccuugauaaccacuguaacucuuuacaguggccaucuccuugguaaccacuguaacucuuugggaggggcauuuuucuguugucuuuuuuuaauuuuuuaauuuuuaaauuaauuuuuuaaauuuaauuaauuuaauuaauuaauuuaauuuuuuuagagacgaggucucuaucgcccaggcuggagugcaguacugcaaucauaacacacuguggccucaaccuccugggcucaagugauccuccugccucagccucccaaguagcugggacuauaggcaugagccgcugugucuggcccucuguuuaucuuuauuuuagaagauuauuuauuuauuuucuucuuugugcuucauuggauacaaaucuguuaauuuuguuuuucuuuuuugagacagagucucccucuuauugcccaggcuggagugcaguggugcaaucgcagcucaccucaaccuccaccuccuggguucaagcgauucuccugccucagccuccugaguagcugggauuacaggcgcgcgccaccaugccuggcuaauuuuuguauuuuuaguagagacaggguuucacuauguuggucaggcuggucuugaacuccagaccuugugauccacccgccucugccucccgaagugcugggaugacaggcaugagccaccgcaccgagcuuaaaucuguuuauuuuuauacauauaaauuuaccuuagaaauaaggcuuaguuuugauuuauucuguuuacauauaucaugcaauuagguuuuuuaaauacuuaguugaucuuuguaugacuguggaaagauuacauauugaucuacuuuauuaacuuuaagugauaguaugauugccaugguuuaauuauucccauauuaaugacaauuauuuccauuuagucuuacugcagacacugcuauagugaacaccuguccauugcuucuuaguacuccuaugccaguauuucucucgggucgauuucaauagagggauuggcuggguuaccgguuacaugcauaacagauacugccagauugcccuccagaacgcccccaucaauuuacaguccaccuucuuuguauaaaaguagcaaucuagccgggcgcaguggcucgcgccuguaaucccagcacuuucagaggccgaggugggcagaucaccugagguggggaauucaagacaagccugauuaacauggagaaaccccaucucuacuaaaaacacaaaauuagccgggcgugguggugcaugcuuguaaucccagcuacucgggaggcugaggcaggagaaucgcuugaaccugggaggcggagguugcggugagcugagauugggccauugcacuccaaccugggcaaaaaaaagagcgaaacuccgucucaaaaaaaaaaaaaaguggcacucuccccacaaccuuucccuaggauugcuaucaguauuuuaauuuuuuuccaacuggauggcaugaaaugaaauuucauuauuuuguaauuuucauuuuucuaauuacuaauuaggccaaauaugucacauggauuuuggucaucuguauuuauuuuucugguuugccuuuuuaauauaugauuauuuucaucggacuguguguaauuuuaagauuuucauagaaauaguuuuuuauuuauauauaguccuuguuauauaagcuacaaauaguuucuccuagucaauugcuuuaaaaaaaaaacuuuuagaguuacagaaaagauaaaaauaguagagcauuccucuguccgccucacaguuucacuuuucucuaguguugucaucugucuucgucaucuagggcugcugugacagaauacgcuaugcauagucugcgugguguagacaacagaaauguauuuuguuacaauucuggagcuuaggaaggccaagaacaaggagccagcgggguuggcuucugcugaggccucuguccuuggcuugcagacugccgccuucucccuguaccuccacgugaccuuuccugugugcauucagugggagagagugcucugguaucucccuuuuuuuuuuuuuuugagacagagucuugcucugucacccaggcuggagugcauugcgugauuuuggcucacugcaagcuccgccucccggguucaggccguucuccugccucagccuccugaguagcugggauuacaggcacucgccaucaugcaggcuaauuuuuuguauuuuugguagagacgggguuucacuguguuagccaggauggucuuaaucucuugaccuugugaucuacccgccuuggcuucccaaagugcugggauuacaggcgugagccacugcgccuggccuguaucucucaucuuauaaggauaucagucccaccuguaugaccucauuuaaccuugauuucuuccuuaaaggcccuauucccuguagucacguugggggucaaggcuucaacauaagaauuuuagggacacaauucaguccauaacaucaucuuacauuacuguggcacuuuaagaaaccaacacugggcugggugcgguggcucaugccuguaaucccagcacuuugggaggccaaggcgggaggaucaccugaagucaagaguucgagaccagccuggccaacauggugaaacccugucucuacuaaaaauagaaaaauuagccgggcuugguggcacaugccuguaaucccagcuacuugggaggcugaggcaggagaaucacuggaaccaggaggcagagguugcagugagccgagaucgcggcauugcacuccagccugggcaacagagugagacuccgucucaaagaaaagaaaaagaaaccaauacugauguguuauuauuaauuauacugcagacuuuauugggauuucaccagcuuucccauuaaccuuucucuauucugaaauucaauccacauugcauuuaguugucaucugccuagucaccuaaggucugugaaaguuucucagucuuuccuuguuuuucaugaucuugacaguuuugaggagaaugggucagcuauuuuguagaaugugccucaaauuggguaugucugcuugugcuuguuuuccucaugacuagacuggauuuuuggcaugaauaccacagaaggugaagugcccuucuaucacaucuugucagagguacaugaaauccacacgacaucacggguuagucacgagcauuugguuaaaauaguguuugcuaaguuuuucuucuguaaaguuacuauuuuucccuuuccacacuguauucuucgaaacaagucaccuaaguccaguccacacucaaaggggacuaaggagggguuaagcaucacuucuuggagagaaguagcuacauguguauaauuuggaauuguucuaugaggaagauuugucuccucuccauuuacuuacucaaucacuuauuuaugacaguauggauucaugcauauuacuuuacacuuuggauuaaaauccaauauuauauacuuacguuguugcucaaauuguucuuuauuugacuauugcaguuuuucagguuggcuccaguaucacacucuucucccacccccuuuucuuaaaagauauuuuuauaguguguucuguaaauuugguuuucaaaucuacauaaauggaaucaugcuguauuuacucuguuuuucuuccagcuucuuucacuaaauguuugugagcauuguuugugauguguguggcuguagccucaggcacucucauugccauauaauauuccauuguaaguaaguucccauuugggcuguuuucaguguuugccuauuauaaauaaugauucuaugagcuuuuaaaaaauaccuuucuuggugaacauauguaugaauuucuguuguauguaaaucuagaacuggaauuacuaagucagaagaugugcuauguuuauuuuuuguauguaaauacugucagcuuucuaaaaugguuguacugccgcuguaaucuuaaaugcugcaggauagagggagaguucgguggggucuuggcaccauggauuaguggucuggccugggaguggcauucucaccucuguucacuuaaccacaaagcagucagcacaagcagucccaccauggccugggauguggagagccagaauuauuauguucaacuuuuuaauccagaaauaauuaauuuuuuuugaaaaauggugugauagagggagacauuuuuaggcaaaucauuuucuucagauuuuuguuugacuacauuccguagauuuaaauaagaauucuuacugacauuaauuuauguugaguuuucuuuuaaugucccauuauugcaaguuauuuagaaauggguuuuaaguguuuccauauugauagauugauagauuuuuuuaugaucuuuucaucaaaacuuuuuuuuuuuuuuuugagauggagucucgcucugucacccaggcuggagugcaguggugugaucucugcucacugcaacuuacaccucccagguucaagcaauucuccugccucagacucccgagaaaccgggauuacaggcacaugccaccacgccggcucauuuuauauuuuuaguagagaugggguuuuaccauguuggccaggcuggucucgaacuccugaccucuagugauccacccaccucggccucccaaaguguugggauuacaagcgugagccacugugccccgccaaaacauuucuuuuauuguauuguagucauugaacauggucuauguguaugguuucugcuuuccagaauuuguugagaucuccuugugaccuaacacaugacaacugaauacccuauuugaaaaguuuuuguguucuauauugaaaacaguucuaucuauugggucaugccacuaauuccuuauuucauuuuuuugaaguguguuuagucuucuaugauuauggauguacuaauuacuccuauuuucacuuguuuuugcuugauagauuuaaaaucuguuaugugugaugguuauaauuuuuuugguaaauuauaucuuuuuuuuuuuuuuuuuuuuugagauggagucucgcucugucgcccuggcuggagugcaguggcuugaucucagcucccugcagucucugcauccuggguucaagcaauucuccugccucagcuuccugaguaucugggauuacagguacccauggccaccgugccagcuaauuuuuguauuuuuaguagagaagggguuuugugauguuggucaggcuggucucaaacuccugaccucaagugauccaccugccucagccucccaaagugcugggauuacaggcaugagcgaccuugccuggugauuauauaucuuuaaacauuaaacaccuuugucuuuuaauugcuuuuuauugugaauucuuuuuuuuugagauggaguuuuugcucuguugcacaggcuggagugcaguggcaugaucucggcucacugcaaccuccgucuccuggguucaagcaauucuucugccucacccuccccaaguagcugggauuacaggugcccgccaccaugcccagcuuaauuuuuuuguuuuuaguauuuagacgagguuucaccauguuggccaggcuggucucaaacucuugaccucaggugauccacccgccucagccucccaaagugcugggauuacaggcgcgagccgccaagcccagccugugaauucuguuuuaucugauguuaauauugcuacuuucuuuuuuccuagcaacugcauagcauaccuuugucuauccuuucauuucaguuuuuucuguaaggcuuuguuuuuauugucuuuauuaaacauauagcuugaggacuuuuugggguuuuuugguuuguuuuugauagagaugguaucucacuuucuuguccagguuggucuugaacuccugcauucaggggauccucuugccuuagccucccaaaaugcugggauuaugugagcccagccuagcuugaauuuuuuaaacucauuuugaaaaucuugucuuuuaacaggugauuuuuuuugcauuuuaaaauuauaacucauauguuuggacuuauucccaccaucuuauucuguuuuguuugccuuaauauaucuucuugcuauuggguggcuugcucaauuuucuuagugucauuuucucucuugcuguagugauuuggaaaguaugaaaacuuauauaguucuucuagugccucccuuaaaaaaagaacuuacaaaguauuucagagauacaaaugaguauggagacuaacaauguugggggagauguccagggcuucuguagauaagauuacuuuuuucuaccuuaguuccagaccagcugauugagaaacacaggagucaaacagacaaagauuaaaauuaccaggcuugguuuaucugugugggcauuuagauccgaaggcaacuggaauuacuugcgcaagcagccacuggcacaucggacaaccacaaggacagauucuagacagugugucugcaaauggguagagccuucaacaccccggauccaugggugauuguguagaauagugccuccuccacccucuuaucuccggaggacauguagcaccggcaagaaauaaacauccguuguaaaucacaucacuaagauuucaggguuauuuguugucacagcuuauucugacgaauaaacucaauucaucauaggguauagagugaaccagaaccauccuaauuguagguuuggucagucugaaaaagaggagcaggaaggauaguuaggcuucuucaucuugugcauuucuuaucucacucugugcucacguauuuauugggguguuagcuuuuuucucuuugauguauggugcuuuguaaauucuaaauacugacacuuuauugguuuuauacauugugucuaucuucuccuauucugugaguuaucuuuuuaaauuuuguuucugggcuccuguguuaaacagaaacauuaaaucuuuuuuuuuuuuuuuuuuuuuugugagaccgaguuucgcucuuguugcccaggcuggagugcaauggcgcaaucucggcucccagcuaauuuuuguauugaaacacuaaaucuuuauguaaucaaguuucucaaucuuuugcuuuacaguuugggucuuuuuuguuuugaguaaaaaagaaauccaucccuguuucacuaauaugaguuauuuuccuauauauucuuauaaaacuuuuaaagcuuuucuucuuauaucuagguuuuuaauccacuugagguauuuuuuugucuuugguguguagugguguaugguaugagauagggaucaaauuucuucccucccccacacccaaaaacauggacaacaaguugucccacguguauugaauauucuucucccauugauuuguaaugucccuaaugucauaugagauguuuucauuuauauguggcucucaucuuugccuauuauaucugugccaauaguacacugugccaauacugccuaaauucuucuaaguuuuaauaugugauagaacaggagcccccuucuuggucuuuuuuuuuuuuugagauggagucucacucugucacccaagcuggaguucaguggugcgaucucggcguacugccagcuccgccucccggguucacaccauuuuccugccucagccucccgaguagcuggggcuacgggugcccgccaccaugcccggcuaaguuuuuguauuuuuaguagagacaggguuucaccacguuagccaggauggucuccaucuccugaccucgugauccgcccaccucggccucccaaagugcugggauuacaggcaugagccacugcacccggccuucuuguuuuuuuucacaauguuuuuuguucuucuugguccugugaucuucuggauuaauuuacauguauuaacaugucauauuccauguaauuuauuacauguaacauguaaauuuauuacauuuaauucauacaucagcaugcaauuuacauguauuagcaugucagguuucauguaguuuauuacauguaacauguaaauuuauuacauuuaauuccuuuauuagcauguaauuuacauguauuaacaugucagguuucaugaaaagaccuguugagauuuugauucgaauugcauuucuuuugagggaaauuacuaucuuuaugauauugagucuuccuguugauaaaccugcuuuauuucuccauuuauccauaagggauaugcacaucuuuuuuuuuucuauuacauuucguaauugcuuauuacaaguagauagaaaagcuauugguuuuuguguauuaaucuucuguaucuagaaacauugcaaaacuuuauuauuuauuugaguaguuuaucugccgauucucaucuguauuuuuuuuguuuuguuuugagacagucuuacuuggucacccaggcuggaguugaguggcaugaucugggcucacggcaaccucugcuugccagguucaagugauucuccugccucagccucccaaguagcugggauuacaggcgcgggccacccauacccagcuaauuuuuuguauuuuuaguagagaugcuguuucaccauuuugguagugcuggucuugaacuccugaccucaggugauccacccgccucggccucccaaagugcugggauuacaggcauaagccaccacgccuggcuucgugucuguauuuuuuaguagacagucaucugcaaacaaggacaguuuugauucuuccuuuccaguuuucucugauuuccuuucuguaucuugauaucagcuagcacuuccacuuacuacauuguuaaaaagagguaaugauagugggaauuuuuucuugcuuuuuauuuuauaaggaugcuuccaaaguuaaggcauaaagugugauauuggcuguuggaacagucuuuaucagcuuaaggaaguucucuuuuagcuccauugugcaaagacuuaauuggaaaugaguguugauuuuaaugacuuccuucucuguuuuuaaugagauaaucgugugacuuuuuccuguaaucuguucauguugauaggcuuuuuuuuauguugaauaagauuaauuuucuuuucauaugcuauugaccauuuguauuucuuuucugaauugaguguucauagccuuccuagauuuuuuaucucuuagguuguguuagggaaaaacucaaacuguuuuuccucugcugucacaucaacacagcaauuaucaacacaaaagaccucuguaauauguguggauuucuguggcagacaccaguuggguguccuccuauucaauucugacaccaucuaccuggagauagcagguugagggcucaguccccaagaccacccccuccuucccacaagucacaaguccgggccucagcaacuucugacugacuggcuucaaguugggguucccgguauccccuguuuggguucaauuaauuugcuggaggaaucggggaaacucacuuacuaguuuauuaugaaggcuauuuuaaaggauacagauaaacagccacaggaagagaugcgcagggugaggucuggaagggucccaaaugcaggagcuucugacaccguggaguuggggugcaccacccuccgggcauguggaugaguucucacucaccauccugucagccuccgugguucagcucuccaggagcccucugaacccuguccuuugggccucuaguggagauuucauugcuuguccaugacugaaggauggacaaguguguugaaauaugauuggacaaaaaggguauaaucuacacccagcaaggccugucuguucagauucuuccagccucucugggcagcauuccuuccuccaggguauggggugggaugcuuuguggaaugagggucuuacagcucacagucauauuagagcccugccuuggguuggggaaaggagagcaggaaaacaucaaagagacucuguuucccaaggccggcuuucugagguccacagcgcccagcauauaacaagauguuguaacaaaacuuaugggaguugggagcuaggaacuguggaugaaaaccaauaaguauauaauuauaauaucacagauugugauauugcuuuggagagacauuuuaucuguugugauaauuaacuuuuauuauaggucuuuucccccaagucucuccuaguuuuucccuuugugacuuguuuuuugucacacuuuaaaauucuguguguuaaauuauaaaauuauucauuauagcccaggcgagguggcucaccccuguaaucccaaaacucugggaggccgaggcgggcggaucacgaggucaggagauugagaccauccuggccaacaugaugaaaccccaucuguacuaaaaauacaaaaauuagccaggugugguggcacacgccuguagucccagcuacucgggaggcugaggcaggagaaucgcuugaacccaggaagcagagguugcagugagcugagauugcgccacugcacuccagccugacaacagagcgagacuccgucucaaaaaaaaaaaaaaauuuuuuuuucguuauaauuuuauaguugucugacagcuuuuucaaaaucauuucaucuguguuuuauaaauaugugauauuagcaucucauuuucuuuucauauauguuaacaccugccguauauuggauaaggccuucuuuguuacugaauugaaauaaucaguuuucuuguaaguguucauauaucucuggguccagauuguacguugcugugcuaaaauccuauuguuuuaauuacuguugauuuauauuugggcaagucuuugaggcugggacuuaaucuuacgcuucagauccaauagccuguguucaaaucccaauucugccacuucccagcagcuuugugaccuugugcagguuagucacuccaccuccuuagagcuaguugacccugguagugcuaaccucacaggguauaaugagcugaauacaauacgcgacacuaaacucuccaucaucguugguuaucauugucauuugaguggguaaugcugcugccgcuucuuuguuaaucaguacuuugaugaacaguucuuccucugcuccccguguucuuuccuacccucaaaaaacaaguggcuaauacagaugacagccugaugucuaugguccugucucugagggacaaucuguucagguggagccuguucucuccugcucccuagcauguaaaaucuccuuucugccugucuguggugaacucagcagagguugacuuccccuagcuguagggaagcuguccauuucuccauuggcucugccaggaccugugaaggccauacacccaguucaagggggaaauacaaagugucucuagguccaaauaggguucuucaaaucuuuccuauuaacaagcacauacgguauuauaauucccaccgacuccuacauauuucuauguuuuaugguuaauuauccccaaauaccuauagcuguuauccaggaaaauguuuuucauuucaaauuuaacagauauuugcuaaaggaagagguagucaaccuggaggcccaaaagucaaaucagaccuacagacaaauuaggcccaaggauggauuuuaaauauuuuuauuaacauuuuuaaaucaugagauuuuguuucuuucuccuauaucauguuacucaaagaagaaguagugaugauguggugcgacagggauguauaggcaaaaagaugacugcugcuuucuguuucugacaacagaaacaucaauggggggauacauggauuuuuaacaggauuauaaaguuaaucgucaagcuuuaagcaaacuuuguaaagagcccuguuucggccaggcgcgguggcucaugccuacaaucccagcacauugggaggccgaggcgguggaucacuugaggucaggaguuugacaucuuuacuaaaaauuagcugggaguggcggcaugugacuguaaucccagcuacuugggaggcugaggcaggagaaucgcuugagccugggagguggagguugcagugagccaagacugcaccacugcacuccagccugggcaacagagcgagacuccaucaaaaagaaaaaaagaagagcccuguuucugguuccagguuccuaauaaauggcccucaacccagcaccauagucucuguaguacuuuauugauguguuacucuaacaauaaaauauuggcauuauguagagauaauugcacaucagaaaucagugauuucccccgaccuguaauauauaaaauacuccuuaaggaauugaacuuaagguuugggcugggagggaaaauuucuucccauuuccaucuagcuacuuuucuaguuucaauuggguuuuuugaaagaaacuggaauuucaagagauagguagaacccaaaacuuguuacuaaccaguucccuuguuuaaaugcauacgaaggauauuuuccagguugccucauacugugcucauuauaugcuuccuaucuugaucaagagucggcuuuggaaaaacacuguuagccugcaaguugacuuuuuagaagcaguguaauuuugaauagguaauacaucguacaaugcaaaagcuguaaaaaggcauaaaucucucuuauucccuauuucuagacaccgacuaugaaggcauugauacguuucuuguggcugcuuccacagacuugcuaccuacgauuucauccacaaucguauacauguguauauaggauuuaaacucacacauagaagugguagcgcuuaacaguccaucuuggcuaucuuuaguuuucaguuuucuuuuuuuuuuuucuuuugagauggaauuucauacuuguugcccaggcuggagugcaaaggcgugaucuuggcucacugcaaccuccaccucccggguucaaacgauucuccugucucagccucccaaguagcugggauuacaggcaugcaccaccacgacuggcuaacuuuuuguauuuuuaguagagucaggguuucaccauguuggccaggcuagucucgaacuccugaccucagaugauccauccuccucggccucccaaaaugcugugauuacaggcaugagccgccacgucugucuaguuuucaguuuucagucuuaaacauuucucccaaacuucccauuuguuggcuccauggagguggcccaguuuauauucccacccacaggugacggaugugagugcucucaaccucccgacacacugcagcaccuuauccaacucucuugaguuuugccagucugaggaaaaaauaguaccucauaguggaacuuugcauuucuguuacuuuugugauaacaaauugagguuagguaucuucucaaugaauuuaacauauuuuuccaguuuaucucuugauuucguuuauguaucuuuugccaugaaaacuacuuaaaaauguguuuauggcuuuuagauuuuguaucauuuagcaaggucuuccccaguuggagaguauaaaaaagaauucaugguuuaaaaaauguauuuuaaaaagucuuugauccaucuggaauuguagaauaagauuaggagguaugcagguuuacuuuugaggcaaaaguauguauaaaguaacacuuuucuauagaaaacuugggaaaauacaggagggaaugaaaaugaaccccaaucccagcaccuucuuaucuauaacaacugagaucaugcuuaugcugggauuucaauuuuuuucacuugagauuaaaauacaaacauagguuuagaauauauuuuaauuuauuuaauguuuuuauggguacaaguagguauauauauuuaugggguacgugagauguuuugauacaggcaggcaaugcacaauaaucacaucauggagaaugggguauccauccccuuaagcauuuauccuuuauguuacagacacuccgguuguacucuuuuaguuauuuuuaaauguacaauuaagcuauuguggacuguagucacccacacccuauugugcugugaaauaauaagucuuauuuauuuguacuauuuuuuugugcccauuacccccacacuaccuuucccagccuccgauaaccauccuucuacucucuaucucuacaauaauuuuaaaugguuguuuaaaaagggugucaacauuuuuguuuuuaaaccaucccaaaccgucccuuuaaaggaaugcaugaccagaggguugccuuuaaaucuugcacaauuaaaagcguuuucucugaggcagcugaucucaggaaaucuugcacgauuuugaagaugcccguuucccauaagacccggcccugcgggggcacuuggcgggucuuggcagagcuaaggggcugggcccugcuccgggagggcgcacugcaggggcccgggccuggcgcggcugcagcaccuccuggcagcaggagugcggcgggggaggcgccaggaggccccugccccggcugccaucacccucgggucugucccuggccuggggcagagcccuuuugcucgaaguccuuuaaucgcuaaggagcuuucccagacucuucccucugcaggcccgcuggccucugacgcauguccccucugcggagcguuugggcacuggaggagcccugguuggcacaggccgccccgcguucccagcuggggaaggaaggcgggcggccaggcggggggaaagaaagcgggagguggggcggggugcuguccguccccacggccucgucgcgcgcggggcuuuuuccaggacuuggggacuuccgggguugcgcugucgugucaggccguugggccgccgaggggugucgcugcgcccgcugccccgcgcggcccuuuaaacuuuguuuuuuaaacuucggggguguggucgcggcgccuccccucucggcggcuggcaguccuugccucugccccgccuuccagaugcuuuggagucaugagccgggagggcgcgggggcagcuuugguagccgaggugaucaaaggugagccgggagggcgggggcuuccccugggggcuccggcacccgcgcugggacagggcgggcagugcuggcuuggaggugccccuagucugggccccggccgcccuugucuccugcguguggguggccucggcacuuguccccaggcucugggcuacagcgcucaugggcggcugugacccuugcgugccugcaccugagccuaguaggugagcugcaccuccccgcccgcgggagcgagauccuugggcucugucacagggaucaaagguccuugugguuggaaaggauuaagcccugucacccauuugaguguuugugguugcaagaaguuuuagcugaggaguuuacaaggaaauaaacgcaguaauugcaugaguugaauugcagaucaaaaaaaaaaaaaaaauaguuuaccauuuggggaaagggugccagcuggcucugcugaaaguauauauauuuuaaaggcugugcuugauuuugccacguugugaguguaaguauuuucuuagcaccacuaguauuacuauuagauauuguggaugacuuuauuucacccgaggauuuuuaggcaaggaaugcggguggagccuccugagccuuacuacucauuaccauucuugcuaaccucacagcagccuaacugcauuuaugcaacacaaguucaucucagacccaucaugcagaaaccucauugcuucuguuuuaaugguaauuugucuaauuguaaaaauaccgaaguagugauuccaaguuagaaaguagugaucccuaagaacaguuggagaaacauaugguuuguucuauagcuguaagcgguaauuuugaagcaauuuugaaagcauucuuucccuuuaagaaaaaaauaguuucuuacugaaaugacuuuuuaggaugucuugaaaaacguagugaaauucaucuagaaacuuacaagguugaugcuagccaucacaugcaugcugcaauuugcugaaaugucuugauccaggggagcuaaacuuuuacaaaaauagguuuguuuagaagucauaucacuacaugaaaaaucaccacuuuugaaacuuacgguuaaaggcaguuucucuuuuaaaaaugugcucauugauuauucccacccaaauagccagaauauuuuguaauuacccauuaccacuccuaccaucugaaacgugcaugaaaaaaaugaaaaauugacuucaucugaaaagaguugugucaugauauaugaaacguuuuuuguaaccuccaggaaggaacauugcaauuuuuccauuucagaucgccuuuguuuugccauucucuacagcagaccaaagagugcaucaaauguacauuauuucagcauagauaaugaacuugaauaugagaaguaaguauugcucuuuaaaagauuuuaacuuuuuguuuuugaagaaucuaaagguaugguuauaaaugggauggccugggaaaauuauaaaucuauugauugcuaauuacaggaugcuuguuuuucaccuguaguaauaaaauaaaccuuuagagcaaaaaaaaaaaaaccucccuaaauuuaaacauuuagauuugcuagucuaauauuuacacuacaaugagauauaaauguguacuaaguaagauauugugguuuugcccuuggaaauauguguggaaaaacagcuuuuuuaauuuagaagguauguucauguucauugagguuacauguaggcauuauagcacuuguggcauuuuuaaguaggcauuauuuaccagaauagucuuccaccaguaaaacaguaccuuuaaguuguauuggcccauaacaauuugguauaugcuugcuuaucuuaauuugaucuuguagacccaaaaaaggcauuuauauucagagcaucuagaauguacaucacauuuuuauuuuucauuuuuaaagcuucuacgcagauuuuggaccacucaaucuggcaaugguuuacagauauuguugcaagaucaauaagaaauuaaagguaaagucuuuaagauuugacuuaaguaaucauuguuagcuugaucugggggacgaaaguaaggaaaacaucucuuuuuaaaaaggaaaugacauguuuuucacugcagugguguuugggacaugcacaugguuuucuuguuuuauaagaucauaguguaucuauuuguuuucuagaguuuugaaugaacaguuuaaguuugggucguuugguucuaguuugaauuagugaugcccaaauacuugaaaagccaaagugggaaucaguuaauuaagugaaccucguauugucugaccuaauagaacugaaacuuaacaagagaaacucuucccuugcuguggccauuguucuuucugccuucauuuugauggggagugauagcaaacuaacaagaaagcuggacucaucuuacuuucucuccuauuuugaaacucccaugauacuguacuacaugauccuuuauacauacgauuaaggggcgugagaaucuagggcaaauaagcaugucauuaaggcuguauuacugagaguuacacaaguauauuuguauugguuugaacuuagaccacauucauguauguaaaacacugaauuguuggccaugcacgguaggaaguuauguauguacugcuuacuagcaguuccaaaucagucacuguaaauucucaacuggaaaauacugcuuuuugggacaggcacuuaaaaaaaaaauuuaauugaauacagagaggaaauaaaauuuauuuuuaauuagaauuuuaacaugcuuuaauuaaaaauucauggguaaggcagauguuuuuccuugaccaugaaagcuauauugcuacagagcuggagacucuucuuuuuugccuuucuuaaauaggaauauaacuauuuauggccuugugcauuugaguucccccuccuuuuuccaguugccaguggcagaucuuuuguuucaugcaggacuaggaagcuaaaaauaauucucucuuccuccaacauuuguuccuuugcuuuaauuuuggaaaaaaauuuuuuuccuguacucaaccaucuguggacuuuuagucuuugggucaaccaaaaauguaucaguccuuuuuuucuucuuccuuuuuuuuuuuuuuuuuuuucccgugagacagaguuucgcucuuguugcccaggcuggagugcaguggagcaaucugggcucacuauaaccuccaccccccugguucaagugauucuccugccucagccucccaaguagcugggauuacaggcaugugccaccacgcccagcuaguuuuguauuuuuaguagagacggaguuucuccauguuggucaggcuggucucgaacuccugacuuugugauccauccgccucagccuccuaaaguacugagauuacaggcgugagccaccgcacccaccagaaaacuuuuuaacauauaaauagaaauauguacacaucauggauguagagcucaauaaacuuucacuaauggaauauacauagaugauuaucuugaucaccagucaggagcagugcacuggcggcaccccauagcagcccuccaugcugucuuccaguuccugucucugcacaccccuccccugguuauucacugcccuggcuuauaacacuguagaugauucuguauaccuuuuuauuuuaacuuaaaggcuuuggggacagauuucuuuaaaaaccaaacagaaggaaagguggucuuuucuaccacucuugguuugcucuuucagaagcagcccaugcuuuaagcauguguccauucauguccccuccccucuucucuaauuguauguucauucucaucccagaaugugccuuuuuaugggaagauauaugguauuuguggguaucaauguuaaucuuuucaaaggucuugcuaauaauaugaaugguuaugggauuuggaauugaucuucaucacaaaaugaaauuguggaagacuugaaauuaaaaagaaaaugcuaacaguuauuuauuuuuaugcaguccauuacaauguuaaggaagaaaauuguucauuuuacuggcucugaucagagaaaacaagcaaaugcugccuuccuuguuggaugcuacaugguaaguauuuguuuuccuaauguauucauaaaaaugcacacaacagugguucuuuacauuugcaguuggaauuuugaaaucaagauaaugucuugauuucucuucagaaagaacguguuuugcuuuuaaaaaauugaccaauucaaggaagcugugcuuauguggaaguagcagguagaugagagaucuccuguaccuuccacuuaauuuugcugugaaccuaaaacugcucgggaaaaaagccuauauuuuuuuaaaaagugcccaacuacuuuggcaaagguuuauguuuuauggcacuaaagguuggaaaauagugcuccaaagcuauuucuauucacucgugauccauuuagugaguuguaaaaucaucuuacuggggucaggaccccacuauuaauuuucuaaaaauuuuuuuaaaaagugcuuucuaaaauuugaaucuaggcauuuuuccccuaauuaaggucaucuccuuucucaucaaaacaucuagcaggaggccacgggaugucaguguugucagaagauggguuacauaccacacggauuacauacauaugccaucaagugcuccauuuggaucauuggaaauguacuuuggaauagcaguauuuacauaagaguugugaauuucauuuauuuguaaauaugauggaaaagauuuauuuuuugaagagucacauuuuguuuggcacccaguggauuugucugcaggggcccugaaagcugcaauuuuuccagagccagcuuagagcuccuccagaguacuacccccugugucugguggugagaaagcuggccacgcuguucaguggggaguagccaggggauguuucuuccacccccaccccaccaucaguguaauaguuauucucucugagacuugaaaaaaaggguuguuuuggccgggcgcaguggcuuacgccuguaaucccagcacuuugggaggcugaggcgggcagaucaugaggucaggagaucgagaccauccugguuaacauggugaaacccugucucuacuaaaaaaaaaaaaaauacaaaaaaugagccgggcgugguggcgggcgccuguagucccagcuacuugggaggcugagggaagagaacgucgugaacccgggagguggagcuugcagugagcggagaucgcgccacugcacuccagccugggcgacagagcgagacuccgucucaaaaaagaaaaacaggguuguuuuuggagcucuuuagguucuuucuuccccacuucuagcuugcuccuuaucucuggcaugccuuaccggaccauuuuaaaauuauuuucuggaguauaguuugauaaucuggaauuuacaaagacuaguccaaaaguuggugauauuaguugaaaucguaccucaagauuuaauaauuuucuuuuuuauguauaagguauaucauuaacagcagugguuaaggucuuuguuuuguuuuccuauuuaugcucacaaaaguugaauuaaaugcuucugauugggaggccgaggcaggcagaucacuugaggucagguguacgagaccagccuggccaacauggugaaaccuuguuucuacuaaaaauacaaaaauuaguugggcgugguggcacaugccuguagucccagcuacucgggaggcugaggcaggagaaucccuugaauccaggaguuggaaauugcccugagcugagaucgugccacugcacuccagccugggugacagugagugagacuuugucuccaaaagaaaaaaaaaguuucugagaaaacuucaaaauuuauuaucaucccugaaaguaugaaacauagguuauagauugucuauuaaaauuugguuucauaagcuuucccagacguauugguguuuuccuuucucccagccucucuugguguuucucguacuugcagcaaaagccuuaaaaaaaaaaaaaaaaguuugaguaguuuggcaggcgugguggcaggcgccuguaaucccagcgacuugggagaaugaggcagggaauugcuugaaccuggguggcagagguuacaaugagccgagaucgcaccacagcacuccagccugggcaacagaaugagaccccgucucaaaaaaaaaaaaaaaaagagaaagagaaaagucuauguaugaacccaagaaagaaaaagaguauggagaaguggguguuuuaacugggacauuugguccuauuacuuggccagucacuggggagaggaaccucauagauuaacauaaaucaugacaacuuuauagaaaaaggaauucagccagaauucuugagauucauaaaauauuaaagggaacccuggagaaaugguccuuggugugacagaaaaaaguuccaaccguucuuuguggaucuugccuuuacacugaccuggacaaagucuggauggcugaaguuccaucuaggagagagugcuccugagcagaacuccaaagcagaggggccagaccgggccacuuccgggucaauugcugucucuggucagaugagaugucccugagaugguagggucuugaggagccaggcacgaggacuacagcgugaagaaccucucugaagguggcuaugggcauagugggaacucagucaggguugucuuaaaaacagaaacagaaugugugauaaguuuauaaauaagaaaucacucuuuuuaagucuuguugcugucguuuuuaaacuacuagugaacaaacaacaaccccuugacguauguauugaaaauuuuuuggcauauuuguuuccaguuuuauauuggccuuuugacuuuguuuaugguuguauuuuggaccacagaagcuuauuuuucuauaguuaauauaucuuagauuuagaaauccuuccagaauuucacaccuucagguuaguacugauuugauugguuagggaagugccagguaagcaaauuuggaucuucacucgcauuuauuacuuacccagugaggagcuagcuuggcaggaggauuauagcucuuggcugugacagaagccuuugcagccauagcuggcugcuaaaauaggaauugggagcuguaauguugauaggcaggaaagcaggagaaaagcuucuaagaaaaggaaauguauucauaguagaaaagcagugucaagauauaauauggacaccugaaaagauaacacaucaaagcaagugaagcuuugaucugguuaaaauacguuaaauccucugguuaaagauuuguggagaugagugcuaguucccuauaaacugauccgcauccuugauaacguuuucuggagucgucaggaauuuuggagagaguaagguucuuuaguguucgacuuggcaugguaauguuaaaacaaaaccaaaaaaaucuggaggaagaaucuuuaggaaagaaauauuccaaauagacugacucuguuuauuuuuaucaguccuuuuugaauucagggcuucugaaaguaacguguuuccuucauccuuguauacacagaaagaccuaauguggguugggcagagagugugagguaauccuuuauggcauggaaauaaaguguuauauuuauuuuuuaucuuaaaaacagaagaggugaggcuucaaaaauguguaaaauaugaauugacaugcccacaauuggucuuuuugacagauggucaggcgucauguguguuacaagaagugagaagagugaguugaguacucauuugucuuuauuguauuucaaaguauugcucuucauguggccugguaaauggcuuucccauucagcuaucugaaugguagacucuuugguaucaaauuagagugaagcuaaaaaucuuuugcaccacuguaagaguugaaaaauauaaaagaugacuugagcuuuuguuuguuugcuuauucacaaaaagguaaacauacuauauuguuuuacaaaauaaguuugcugcccuauuuaagccaguggcuaugaccuggccagauugagggauaaugauacuuaaccugucauuucaaaguaaaggugaaauuuuaaguggaaaauuuuaagugcuuuucaaaacaaauucauaauaaaaauccuuuuggaaagaaaaguuggaaauuuuguuuuguuaauuuuguuguaaaaaugucauacacaaaauccauauuugcacucuugagaaauuuaaaaaaucuuuuaaaaagaaguuuuuauauuucuagaaacaagacgugcacguguguguauaugcacagauguauguuguguacguauauguuuuauguuuacaguacaauuuuaaaauuuuuuauugguacauaauuguacauauuuauggguuacaugugauaguuuuauacauguauauaaugugugacagccaaauuagggcaguugcaguauccaucgccucaaacauuugucauuucuuuguguugagagcauuuuaaaucuuccuuucuauuuugaaauacacaguaaguuauuguaaacuauagucacacuacugugcuaucuaacacuagaacuuguucauucuaacuguacauuuguaccaaagaaccaaccucucuucacucccccugaccacacacgcccuucccagccucugauaacccuuauucuacucuuggccuccauaagaucaacuuacuuagcuccugcauaugagugagaacauaaugguauuugucuuucaacuuugguuacaucuuccugccacagcaguuagauuuucugaagauacaugguauucaucucuucuauggguuaaauguacuuuugagggcuagccugggaaauuaaccaccauuucuaacaucuuucuguguauaaaauaaaugccaagcauuuuguguaaaaaauaaaugacacaagcaaacuuuuggcacguagcuugcaaauuugcuuuccucuaauguuuaauagauuacuuugguagagcuaauuguaacauguagguucccuguucaaaauuuaucacuguauauuauuauuuuuuauguuuaagcaguuuuuauagcuguaagaauggcuuaccuuguaagcauuuauguugaaaaugaugauacuaauuaaauuuaagaauauauuaacucagcaaucugugagaagaauucuaaacugcauuaaauuugagauugccucuacaguuaugauaagagcucagggacuuuguuauuuaaugaugaucuuuugaaucuguggucccacuuuuuaaaugauuuaauuaucuuggacucagaauagccagugccugcaggaggaaaggaucaguugggaaguuaagacaagggaacagagaacgaggaucuagacgcaguggguaagaauccaguucagcaaacagcugcccagaugggacagcagaggcuggaggacagaaugaggucauaacacccuuccugggugucugugaaaggcagggcaaacagcacgaggcaaccgucaguaguagccaggccccagcuagugugaggcgaacugggcugagcaaagggacggcacaggcccucagugggaagccagugcuuccuugggagccggcccugugggaggcagcugucugcccugcucacagugcaucacaguuugacuucccuugccacccgagggcuucugacgggcguuuccacugcccguggugcuugcugggugcuguuaacuuggggaaaaagugaagagaaauggcucucugauagcuuaagauccuugacugcagauccguuaagcuuucuggaauuuugggucccauccuuguuccggucauuguuuuagauaggauggguuccugucuauaaauacggccagaggagcaggcccucuuccaucaauaauaggcggugugaucuuggaugagcaguugaugccaaggucuggaaaguuguagccugccaguuuuaugaaacucacagagcauuauaaauaguuguggguuuuuuuuccucugugguuaaaauuuaggagauuucauuuuuuaaaaaaucaagauuuuuuucuuggucuuuaaaaaaugucccuaccacucaaauguguacuaauucccagggccaauucacuauuuuuauuagcagacuugguagauacguguuugcuacucugaacuuccaguuucauuuugucgaaauugaggaucauuauauauaucauuauauauauguaaaaguaauuuuaaaaguuaaaacuauugaaauauaaguucaucugagguuuuuuuuaacgaguuuuuuuucuuaaccaguuuugugcaggagcuaugaaagugauuuuauuuacuuuuuuauucucuguguucuuuccucugcucaccuuuuuuauugagcaguugaauguguaagccuaucuucaacuugcauugauuugugagcauucuuuguuaaucuggagagagugauuuuuuuuuuuaauaaucaaucaaguucuuggcguaggaaagacuguaucaucuggcugacaugaaaauagucacaagagucuuuaagugcuggaaacauugugacaucucuccaggauuuccugguuacucaggcugccacauuuguugcuggaauuucaauauccuuugucacucucagcucuagggugaaaugacuuguguaacguuuggguucuaaauuguacagaggcucucuaaguauauaaauaaagcuucagaauccugugcauaagaguagaaauaggaagcacaugucuaauuggguuuccaugauuugaggcccggcuugucagcauugaaacauugaaaggagaaguaaugcagcugggauccuguugcuucuguugcuuguucuuccaucacugcuaguucaauaccuccgagguuuugaaacguauguuaguaaucgaggguccagcguucucacagggacucuggcaugcagauggugauuuuagaaaguggggguggugggaaguccugggaaugguugagguauuguucagcaaaaaaagaacuuugugccaugacuuugaaaaccacaccagucucaagcauuuucaaccacaguauuugcguguguuugugugauauuugcucguucagagagagucuuuauccuagagaaacaaggucuuacugaugccuccuaagcugcaucucugugcuuacgccucauguauuugucuauucacuuuuaacaaauggaaacggccauuuccuuaaauugagugugcuacugcacacuauugcugcccagcaaauuacugcaaaacuuugugaccuaaaacaacaguacgaauugucuuagaccaugucuaugaguuaggcaucugggaguugcuuaacuugguugggucuggucugguucuguaccgugucugggcugcauucaccuggaggguccaugucuaagggggcucagucacauaccuggcagguuagugccgauugcuggcaggaggccucucuuccauaccacgugggcugcuugaguauccucccaaaauaacagcuugcuguacccagagcgaggguucuaagagaaagcaugacaggagcuaccucuuuuaugaucuagccucugaaaucacacccuauuacuccaguauccuguucguuacacaggggcacccuguucaccgugggaggggaccacacaaggguggaaaugccagcagaugagacucuuugggguugccugggaagcuggcgaucacagcuggucagcagcucucuuggucaucauuuguuguuuccuguucuuaacuagcacuguggaauuagagugggcauucuauauauauagcuucucaugaaaauauaucaaaagaauuugagaaacgccaaguguccagacugccagaagcacggugauagaucauaaguugcaucaauuuagaguuuacuaaucugagaauuuguguuaauguaggaguuauuuauaggauucuucuuuaguaacaaauuuagaaugauuucauuugggaaggccuuuugaaucagcaagaugaguagguguaaaaguaaaaguuacuuccuucaugccuggccaaaaaagaaaaaaagguaaaaguuauagauuggcaaauauaucuuugauaguuauauaaguggauuuguucugcaucuguaaacuuccuucaguuuaucuaguuaugcuuuacauuauuuauuuaugugccagcauuccccaacuggauuuuuaaauuacagucuuuuaaaguucaucgucaggaauuuagggguuuuuucccccauaggaaaaaaauguuacauuguucuugugguuuuuugaaucaaacuaguguuccaaggcuaaaccacaguccuuaauguauuacagacuauuuuugcuuugaaaguuaggagaaaguaauaccauugcaauuuuacuaauuaaagaacccaaagaacuguaaucacaagcaggaaaaauuaucuuaaauuagugcuuaaggaaaaauuuguauaauuugagagaaggccuuagaaauuuagagaaauuccuaaaugggucucuagauuucauuuuaguacacagaugaaucagacucuauucuuauuuuuauuggcuucaagguguuuuuuuauuugguuuuguuuuuugguuuuaggguuuuguuuuguuuuuuuguuuuugccuuuugagacugacucuuggucugucgcccaugcuggagugcaguggcgcgaucucggcucacugcaaccuccgccuccuggguucaagggauucuccugccuuagccuccugaguggcugggguuacaggagccugccaccaugcaggguaauuuuuuguauuuuuaguagagacgggguuucaccguguuagccaggauggucuccaucuccugaccucgugaucugccugugauggccucccaaaguccugggauuacaggcgugagccaccgcacccuuccgguuuuagguuuuguuuuuuguuuuuuuuuaaucugcuaggaagucuuaaaauagaauggagaaaaugaaagacuuuacugauguuaucugguaaguguuagaagaggcauacaugcaucggagacuggaagggaauaagggaauuuggaaaaaacaggcugauuuuuuuaaauguuuuaauuuucaugacuuauagguugaugcuuagaagaucuguguguaggccggacaugguggcucaugucuguaaucccagcacuuugggaggccgaggcaggcggaucaccugaagucaggaguuugagaccagccuggcaaacauggugaaaccccaucucuacuaaaaauacaaaaaaacuagccaggcgugguggugcacgccuauaguuccagcuacucgggagguugaggcaggagaauugcuugaaccugggagguggagguuacagugagcugagaucacaccauugcacuccagccuaggcgacaagagugaaacuccaucucaaaaaaaaaaaaaaagaaaagaaaagaaagaaacagaaacaggccagucauugggaaaauuuuccguuuaugagucuugagucagaaaauuggugaaaugcccuuuggaagcugagucagugcuuaugacuaguuuuaggauaugucuguuucugaguuucuaagauccuugcuggaucuuugaacuuugaaaaauuucucuuaguccagugauaguuucacauugauaucaacuuuuauuaaacauuuaaaauuuuccuaacuauuguaaguagauuuggguucagcuaaguacaucagugaaucggauugguguguaaugaaaccauaagacaugggucccaacuucagaaugcuucacauuugguuguggaaacaggucacauguaucauguuaaguaauggagauaaaaaguuugcaauuaacuuuuuuuagugauuucuuuuuuuuuauuagugaaauuuaaaaucuauuuccccaaaguaaucuuuggaguucaaccuaauuuuagugauaauauaugugccagauuuaaugcuguuucuccuucccaccgcucccgccuccccaaccccaaccuuccguacauuaguugaaagggcccugcaggaagguucugaagucccaggcaaauguaauaggggguaggcagaggacuuacuuagagagaugguggugaaagucucaaacugcagauuucuagaacaaacagguuacuuguaagaagcagacagagauacuuagaucaguaaaauacuucuguaacacuagaagugagaagacaugagaacguuaucuagaaacuaucaagaggaaaugacugcagaccaaaaauccuacgcauaguagucaaauaaaaaaugucaagggaaaaaaaaaauguuuggaaaggcaaggaauaccaacuauagaccucaaaugcugaagaauauacuugagguauucucccagguuaaagucaaagcauagcauaguucuaaggacaaaagaagucaaugagcgucgaaaacaagugcaguuugauaaucaacuuguucaguauugcaagcccucacaccuacauggacagaguuaaucacagucuguguucugccuuugugucucuuuccaccucaccccagucuaaccccauccccaucuccuacacgcugcuuagcugucauuucaguggacuuucaggaaggaggggagguaaaagcaugggaucagucuaacgucuugauuuggaaaaucuguuuuuaaaauacugugcuucuuaccacaaaagguugcugugaagaguuguuggucagggcuuauacugcaaacaacagaaaccagcaauggaggauuuaaacaaaaaagaaaucuauggacaggauucugggugauuccuaggcuccuggggaaggcuggagaacccugcucaguugguuggaaauuggacaaaauuuacuucgcagugacagcacuguaucuucacuuagaaauaaauugccuuuuucuucuuuuuucaaacauagguuauauauuuggggagaaccccagaagaagcauauagaauauuaaucuuuggagagacauccuauauuccuuucagguaaauauaagaaugaugugguagauucagguaaucagauccuugccagaaauaucuugauaguuguuucugaaaaaagaagaucugguaaauagucauuuuaggaugagcgcaaauaacaccacagaucuggguuuuuccacagugacacuguugacguuuugucauggaggcuaucuugugcgucguagcauguuuaguggccuccguggcuucugcccacuagaugcugguaaaauccccacacccacucuaauugucaaaacucagaaugucuucagacauugccauauaucccuguaagugaccuugggggauggagagcaaaaucucccuacgcugagaacuacugccauugaugaaaacuaagcuuuggcugggcacaguggcucaugccuguaaucccagcauauuggaaugccaagguggaaugauugcgugagcccaggaguuccagaccagccucggcaacaaagacagaccccaucucuauaaaaaaauuuuaaaaaaaauuagccaggcgugguugcacaugccuguagucccagcuacuugggagacugaggcuggaggauuguuugagccuaggaguucgagggugcagugagugagcuauggucauaccacagcacucaagccugggcaauagagagauaacuugucucaaaaaaaaaaaaaaaaaaagcaaaccccaaaaccuaggcuuuguaucaggugagaauccuggguuauuguacucaaaacuaccacugaggagugugguuccugagaaguuaagaaacguucccaauaaucaguaguuacuuucugggaccaaaaugaaccccuuuuuucuggggacacagucaguagagacagucgauaagguugcuaaugcaguaccacuuccagaaaaaccagucaagucacuguguuccagaggugguaguuagugaugucuacaggaauggaugacaucaucucaaacuuagcaugcgauuguguugaagauauuucuagaagacuagugcuuaaaucaaguucuaaaaauuuuucugcucguuuaucaaaauacuugacuuagcucuauaguuuaaauacuuguaugguacuuaauggguaauaaauguaugaaauaauuuuacucauugaagacuuugauauuuucaaaaacugcuuguucuuccauucacaaauuaauaauaacuauugcuuauuaguucauuguucaaacuaauuaguucguuaguuuaucguauuaggauuguuacauaaaccacaaaugccugauuuugaauguauggcccuaacuuuaaaaaagggaguuugugaaucugacuuuauuguagaugagccuugggauggguauuucuaauuauuggcagaaucucccuuucaaauaacuuuauaggccugccuguggacuuacuccaugaaauaacaauuugucagggcagucugaagacuucaguaauacgcugcaugaaaaauugugaaaaucugugauugagcaaauuagaauuggcuugaacccaguaucaucccuuucugcuagcucauggcucaucuuaaguauucuuuuauuugagguggguaggaagggaagagggggaaauaaagaucauuuucuaagcuggaaaauucuucucaaccuauaacauaauagcaaccacauucuuccuuuaaaagaaaugcuuguauuuuuggucuugagucacaggcaccuuggucaucucuugauguagugacauuuguucuauagaacucuucuuuauaaugguaaucuuuugugaugccacucuuagauuuacagcacaagguccugaaauaggaacaugcucacacauuucgcacugugcaaugaaggauccauggaacacuguugaugugaaaaaagacguuuugaguuaauuuaaauacaggugccaaaaacagaauaagcauugcuuacugccuugcuauguuucaaauuauuaaaguuuggcacugagaaaugaaguuaguuccuuuuggucccaggagcaucagucaguaauucuccaaaaggcaagacuuagcuagaaaccauucagcuuuguggaauuugaaucucuucuauuguagauacuagguauuugauuuaucuaaacaguguuucuuucuuuuuuuuuuuuuagacggagucuugcucugucgcuaagcuggagugcaguggugcaaucuggacucacugcaaccucugccucccaaguucaagcgauucuucugccucagccucccgaguagcuaggacuacaggcgugugccaccacgccuggcuaauuuuuguauuuuuaguagagaaugggguuucaccauguuggccaggaugucuugaucucuugaccucaugauccgcccgccucagccucccaaagugcugggauuucauaaaguguggccugugaacuggugccgaucugugacauuuuguuaccagccuguguugagauaaauacagaaguugagaauaagauuuuagaaacauuuauaguuaucgaauagagcaauuuuaugucuguagaaucaaauaguagaagaaauuugagcuuguauuuuguuuuuuuuccccuuucauuuuucuaguaauuuauuuuauucacaaaaauaagauuauugcauuacuggauauguaauaguauaguacuauugcauuucauauuuaucuuacaaaagugucaaccugugauagacuuaguuuuuaaauuuagugcuucuucacauaguguucuauagaacuuaucaauuagaaaguaguccaaucagaauuaauaaagccugauaauauuuugauagaaaugacauuauauucuuuguaucuugccacuuuaaguacauagaauaaauaugaccaacaaaguauugcuaacacgacguugugcaagaauggcauucauuuauagcaaauaaguucuuuuauguucuguagcaauguuuuauuuaauuagauuuaauucaacuuagauagaauucucucucucucuuuuuuuuuuuuuuaaagacagauucuugcucugucacccaggcuggaguucaguggcgcaaucuuggcucacugcaaccucugccucccagguucagggaauucucaugucucagccucuagagcagaugccaccaugcccggcuaauuuuuguauuuuuaguagagaugggguuucacuaaguugcccaggcuggucucaacccccuggccugaagugauccgccuaccuuggccucccaaagugcugggauuacaggggugagccacugugcccagccuucuuuaaccacugaguuuuaaaguguguguguauguauguguguguguauguguguauaugauuucuuauugaguuauauuaaauauuucucugugucuggucugcauaauuaaauaguauaaaauauaguuuaauuuuuuuuaaauaucauaggaucauuguuaugaacaguguguauuucuguucucugguauuaucuguuauaauacucuuugcuucuuaguuguuuuuguguguguggggcuugccucugcuuccuguuuucuugagagguaguauuguauauuuguuaauagcuugacuugacaucagacagaugggagucuugcugucagcucugcuacugacaucucugugguccuuuacagauuugagccuuggucuccuagucuuuaaacagaaacaauaggcugggcgcuguggcucacgccuguaauccuagcacuuugggaggcugaggugggcagaucacaaggucaggagaucgagaccauccuggcuaacacggugaaaccccgucucuacuaaaaauacaaaaaauuagccaggcgugguggcgggcgccuauagucccagcuacucaggaggcugaggcaggagaaugcugugaacccgggaggcagagcuugcauugagcugagauggugccacugcacuccagccugggcaacagagcgaggcuccaucucaaaaaaaaaacagaaacagaaacaauaauacauucucucucaaggaguugugaggaugaagugacauccugcauauaaaacacuugguauaggcugggcaugguggcucaugccuauaauuccagcacuucggaaggcugaggcaggaggauagcuugaggccaggauuuggaagaucagccuugcagcauagcaagaccauuucucuuuggggaaaaaaaaauuagcugggcaggguggcaugugucuguaguccuagcuacuugggagacuaaggcaggaggaucccucaagccuaggaggcuucagugagcuuucauuaugccacugcacucagccugcacaacagaacaagaccguaucuuuuuuuuuuuuuuuaagacagacucucgcucugucacccaggcuggagugcauuggugugaucucggcucacugcagccuccaccuccuggguucaagcgauucuccugccucagccuccugaguagcugggauuacaggugcccgccaccacaccuggcuaauuuuuuguauuuuuaguagagaugggguuuugccauguuggccaggcuggucuugaacucccgaccucaggugauccaccagccucggcuucccagagugcuggaauuacaggcaugagccacugugccuggccaagacccugucucuuaaaaaaaaaacaaacacuugauauaguaccuggccuuuaacuaauauuuguuaaauauuccaaccuucccccuuuuaaguugacugucauuuagcuacuuuuuuuugagucggagucuugcucugucgcccaggcuggagugcaguggcacgaucuuggcucacggcaagcuccgccuccuggguucacgccauucuccugccucagccucccaaguagcugggacuacaggcgccugccaccacgcccagcuaauuuuuuguauuuuuaguagagacgggguuucacuguguuagccaggauggucucaaucuccugaccucaugauccucccgccucagguucccaaagugcugggauuacaggcaugagccaccgagcccggccauuuaccuacauguuuaaaaaucacugucguggccgggcgcgguggcucacgccuguaauccugccacuuugggaggcugaggcaaguggaucaccugaggucaggaguucaagaugagccuggccaacgugguaaaacccugucucuacuaaaaauacaaaaauuagcagggcaugguggugcacaccuguaaucccagcuacuugggaggcugaggcacgagaaucacuucaaccugagaggcggagauugcagugagcugagaucgugucauugcacuccagccugggcgacaagagcgaaacuccguccccaccccacuccccgcaaaaaaaaaaaaaaauucucugucuccuagauuucccucccaccccuuuccagucagucaucacccccagcuaaucauugcucugacuucuaccacuaucaguuuugcuugccuuugaacuugauauuacugguaugcauuuuggggagcugucaacuggauuucacauauguaaugucuaugagauuuaccuguguuguggaagguaucaguaguucauccuuuuuuauuccuuuuguagcauuccagucuaugaguauaccacaauuuauuugccugugguccuuuugauggauauuugggucauucguaguuuuuggccguggugaauacgagcuguuacgaaagcugccauucuuuaaaacuaguauuugacauuguugugcaguuucuaagcagugcccauuuauugauucuuacguguuuuccaaauuuguuaaaugaucuuggugacaaggaucccuccccacugcccaaggcuuauaaacugagccucagaguugcuguucugccuauuggaagaaggcugaaugcaaggugggaggaagaugugaugugggugugucuaaaauuggaggugcuaaugaaauacacuugagugagcaaagauucuugucguauauucagauucuaugauguaugaggcaggacuucagcagggcccagaugaaagcgugugaaaucaucacagauuggagcggggcugugccccacaguagguucucaaaaaaaaaaaaaaagcauugaagaaauuugccaaaaugucacagagacugaaucaacaugucuuuaacuugauuggaaaagauuaucaguagguuaagaagauaaucaagccaggcgcaguggcucacgccuauaaucccagcacuuuggaaggccaagguagguggaucacgaggucaggagauugagaccauccuggcuaacacagugaaacuccaucucuacugaaaauacaaaaaaauuagcugggcgugguggcaggcgccuguagucccaguuauuugggaggcugaggcaggagaauguugugaacccaggagguggagcuuacagugagccaagaucgcgccacugcacucacuccagggggagacugucaaaaaaaaaaaaaaaaaagaaaauaaucauacuccuucacagagaagacaugguuaaaaucauugggauccaacuugaggguuuaccccauuuccauugauaauuuugauuugauuuaggcuaaaguacuucauuuuccugccuuaguuucucuaccuaaauggguucuuuauuccaugaacacccuauuucuacaaaaccaggauuuguguugauuuguagguuggugauucauaaacuugaacacaaucacagacaacuagaggaccuguuaagacacaaauuaccuggcccuaucccgagaacuuugauucaguagaugugggguagcccugagaauuugcauuucuaacagguggggugguccuggugcugcuggccuggggaccacugcuggaaguccuuuuguuuuuuucuuucugaauauugccaauaaaguguugguaaaaucguggccuuuuagguuaaagacuuuuucuaggauguggaagagaaguuuuucacuucagaaccuuacagaacaaaaaugguguguucuaagaccuuguguuggcugaacgcaguggcucacaccuguaaucccagcacuuugggaggcugaggcaggcagagugcuugagcucaggaguucgagaccagccugggcaacauggugaaaccccaacucuaccaaaaaauacgaaaacuuagccaggccugguggugugcaccuuuggucccagcuacuccagaggcugaggugggaggaucgcuuuagcccaggaggucaaggcugcagugagccaugauugcaccacugcacuccagccugggcaacauagugagaccgugucucaaaaaaagaaaacaagacccugcauucuguccucaugaagguucgcauagcucaguaauucuaagcagcucagucaguaacauugaagacgauuuuagcuaaaaaggaugccuuuucuugcccucauugcuguaguuuuggcccuuaagguuugagcaagaauuaaaaguuuaaaaugugguuuaguuuuuauucuaacauuuguggaauauucauuuuccccuuuuaaguuaauguauaacuuauaguuuuuaacaaaaacacuaaucuuuuuuuauuuuauuuuauuuuuuugagaugggagucucgcucugucaccaggcuggagugcaguggcgugcgaucuuggcucauugcaaccucugccucccagguucaagugauucuccuuccucagccucccggguagcugggacuacaggugcgcgccaccaugcccggcuaauuuuuauguuuuuaguagagacaggguuucaccauguuggccaggauggucucaaucucuugaccucgugauccaccugccucggccucccaaagugcugggauuacaggcgugagccaccacgcccggccucaaaaacacuaaucuuaaguguacaguaguaagguuuuacauguauuuauguaacuaccacacaguaagaaauauuacagugugaagacccaaauaagguggggaauuagugauagcuccaccagcaacccuguuuccccaggagcaaaugaguaccauucagauaggcacaguuuuucugcaugccuagcuuaaucauaauuaaauuaauuuuuauguugccuaauuccagaagauuucaucuuguaauggcucaagguagccaaaaaggagaagcaggguaggggucggggugccuuauuucucuggguaaaaccuuacuugauauuaagagauuuguauaggaagauuuacugguauguauugaugcaguguuuggcuggaguugucuguaaaguaauauaagcacuuucccaaaacuagagugauccuguggaagguaguugacuuguuaguuccugugguuuuauugguauuacuguccuuuaaaaaucagaaagaagguagggcacagcuguuuacaccuguaaucucaacacuucgggaggccaaaaaggugagaagacugcuugaggcuagaaguuuuuuuuuuuuuugagacgagucucgagucucgcucugucacccaggcuggagugcaauggcgcaagcuccgcucacugcaagcuccgccuccggguucacgccauucuccugccucagccucggaguagcugggacuacaggugccccccaccacgcccggcucauuuuucguauuuuuaguagagacaggguuucaccguguuagccaggaagaucucgaucuccucaccuugugauccacuugccucggccucgcaaaguggugggauuacaggcguuagccacugugcccagccaguuguguggguguuuugggcuuguuguuuuuuguuuuuuguuuuuugagauagagucucacuuugucgcccaggcuggagugcaguggcaugaucucggcucacugcaaccuccaucucucuuguucaagcaauucucugccuuagccuccugaguagcugggauuacaggcgcccaccaccgugccuggcuaauuuuuguauuuuuaguagagacaggguuucaucaucuuagccaggcuggucuugaacuccugaccucgugauccaccugccucggccucccuaagugcugggauuacaugccugagccacugcgcccggcagaggccgggaguuuaagaccagccuugguaucauaaugagacuccaucucuaccuuaaaaaaaaaaaaaaaaguuagcuagaugcggugauacaugccugugguccuugcuacuggggacacugaggugggaggaucacuuaaacccaggaguuugaggcugcagugagcugcacugcaccccaacaugggcaacagggcaagacguuaucucuauaaaaaaguuuaaaaaaaaaacccagaaguuacccaguuaaauggguaaaagucuuuaggauaacgauagcaacaaaaugcuuaugaccuucuaccuaauauuuuaaaugugaccuugauuucucaguauuucugucauacuugguuggagacacacacacacagacagacacacguauaaauagacacacauacacacauauguuuauuacaggaucaaaaagcagucuuucccaguaagauuuucauacgguauuuuccaguuuaaagaaaaaauucaaaugcuuugccccuuugggggagagauagguauugauuuguugaauucaagaagguggcucagcuguuaaagccaaaaauaauccagagagaacauuugaaauuuaggaaguggucauuauugauccaggcccauaaaacaguaccuauuggaauagguagaaacugcagugaaauuuguaauugauuuaucuuuuauuuaaaagucaaaaggcgagauuuuuuucuucuugauaaugguucagaguguacauuugauuuuaaauucuagucaccuuugucuuagguaaguguaauugcagaaaauuaacugaucuacauuuuauuacucuuggguuucagagaugcugccuauggaaguugcaauuucuacauuacacuucuugacuguuuucaugcaguaaagaaggugagugacauguaggaugcacccaguguuguguugaggaacuaacaugcgguccaagaaaacuaggccuucuucccgagaucuuuuuguuaguguuucuuccaagaugccuauggugacagaggugcuccauuucccaacuaaugucagaaugagaccaaaccaggaaacaguuuauucugaauuucugagugcuucuauguaugaguugggggaaaagucacuuaagaaacagggaaaauaagaguuauacgauuagguucuagauccagaauugguuuugaguauauuaugaucuaaaagaacaaaaguaaagaugacuuguuuacugguaaguucucuuugauuuguauauucuauauaccugauuccugccaauaccauuacaacagacguaacacagucacugucaaacacuucauuuuuguuuugucaggcguucaauuucuaguucaacagaauuugaaugccucaauuaguuuguuauacaguuuuaugugaaacuaagugggucacugcugcuuugucaaacuauuuccaagugauuccuugggucauaaccagggcugcuguguugauuccaggggacacccucccuaucacguucuacgugaacaggguccccuggggucacacagugcagcaaguccugguauuaaugucaggacagcaggagaaacuagaaugguaaaucaguagcccauggaucaaauaagccuuugacagcauuuuucuguaacuugugcuuuuagagccaaaaggaacccagguuuacuuucuuguauaaugaaacaugguggcuugcugggaauugugacagacaugucuuaaaacgagaggacuaaucagcauacaaauucagagacuaauugauauacuuuuuucccuguaucaaucaaugagguaugggcacauuguuuggauuugagcccagugacugugggauauggagcugauugggguaguugccaugagcucugaggcggcuccaugggcccucagugugggcagguauggggcacugguggaaaucaggagaccaaagggcaacagguguaaaugguaccuucugguugcaguugcagccccugccaggugggcucaugcaggcaggcacacucaccuuuaaaaagagaaaaguaaagcuuugagggguuuggaaaugaucuauuauaacaccauauggcagcuucuauuauuauuuuuuggcuuuuuuuuuuuuaauuggguauugcacccaaagucaauuagcugguacgauaggucaaagauugccauuugcauacuauauuuuggguuuuuuuaaaauuaaauuuucauuuuuucugcuaugcucagcuaauuuuuauauuuuuuguggagaugaggucucacuauguugccuaggcuggucucaaacuccugagcucaagcgauccacucaccuuggccucccaaagugcugggauuacaggcgugcaccaccgcacccagccacuauauuuaguuuuauuuaagggucacuaucuucugauuugcaguguaagcauuuuuuauuugugacugauuuugaauauugcauauaugaagaaacaugcaucaauguaauuauguuuucagugugauucacuuccaauaagaucaccucaugaaauucaaaggaaaauaggaauuccuuauaaacuacuuuuuuuuauuguuucauucuauuagaaauagcuguaguccaaaaucaugaaauauauugcagucaaggaaauaaauuuugugauugacuuagucuugggauuaguguuuaaauaacuauauaaaaugaagaccuuuuuaguugauauucuagccuucuuauuuuacauuuguauuucaguaguuuacuuuugaaaacuggguguacaaaagcccccucuuugaaccaagaauaccuuguggaucagcaauucuugcuucccuccuguuuggcucagggaucagcagccaggaggauauuucucagaggcugcuaggucuguuuguccuugucucagaaaauagacacucugcuuauuuugguuaucauacucugccugcuaucacacagaguaaggcuauaggauaggacagaaauuuuuuuuguuuuauuccuauggaaagaauaucuuuuuuuuccucaaaaguuuugauuuuaguguugaugucagagcuguuuacuuuagggaacauugauuaaagacuguucggaagaauuugaaaaugaagauauggaugaaguaugaggguuuuguuugggauaaacuagcacauggauucucuccucuuucuuaucgauguagagaccauuggguugugcauuauauuugaauccuaaacuucugaauuuucagccaggggugguagugaucugguaagagaagaggauuacuuucagggcgugauuauuuaacaauacauggauaggaugacuggugaaugaaaauaaaaaagcacaucucacaaacaaaauccaaacaaaacacaacaaacuuauuacauauaguuauaauuaauuuccauauaaaagaagcacuuagaagacgccgcccacuuccuuugaaagcuguucaguggaaaguaaucugaucaugacaauacuuucuuggggggccccugauauuuaguauucugaaauuggauaggaaacuguuuucuuauuugcauccuuguucuuaaaagcuuucuuuuggauuuuaggcaaugcaguauggcuuccuuaauuucaacucauuuaaccuugaugaauaugaacacuaugaaguaagucuucaaggaucauguuuucaacucuuccuccccccgcccagcuuuauugaggggaauaauugacaaauaaaacuuauauauacuuaagauguacaaaguaauguuuugauauauguauacaccaugaaaugauuaccuaaucaagcuaauuaacauauucaucaccucacauaauuuagucuuuuggcgugugugaugagaauaccugagauguacucuagcagauuucaagcauacaguacacacauuagaucuccagaauuuacuuauccucugaugguuuguacucugaccaaaauuucucugccuguuuuuaauuuuucuuuuuuuaaauugaaaaaaaaagagagagaccaagucucgcucuguuaccuaggcugaagugcagugguauacauggcucacugcagccuugaacuucugggauuaaaugauccucucucuucagccucccaaguagcuggaaucacagguauguaccaccaugccaggcuaauuuuuuaauuuuuauuuuuguagagaugggguuucacuuuguugcccaggcuagaguugaacuccuggccucaagcacuucucccaccuuggccucccaaagugcuaggaucacagaugugugccacugugcacggcccuguuuuuagcuuucuuaaucacccauuucacuuacagaagcaauauucuuguuuuguuuuagacguguauagagugaaaaaaagucaagucuucaucuucuuaucccuauuucuccugucccaauucucagugggaauuucugcauuugaugcacaauucuagagugaaugagugugccccguguguucuuuauacuguuuaguuuaaauguauuuuaguauugauggcugucacacagugauugagaugcuuuuaaaacccuuagcauagaauaagaugagaugaauagucauuauacaccuaauuaucucuggaaaauaucuuuguuuuugccauaaccuucgguuugucaggacacuucugguugcaaguuacagaaaguaaacacaaauagcuuaaauaaaaaaggaaaaaucugccaggcgcaguggcucaugccuguaauccuagcacuuugggaggccuagaggggcagauugccugagcucaggaguuugagaucagccugggcaacauggugaaaccucaucucuaaaauacaaaaaguuagccaggcgugguggugggcgccuguagucccagcuacucaggaggcugaggcaggagaaucacuugaacccgggaggcagagguugccgugagccaagaucaccccacugcacuccagccugggugacagagcaagauucugucucaaaaaaaagggaaaaauuuacuggauuacauaaauuaaaaguccaggaauaggauuggcuucuagcaugccccuucaggugcucagacacuuaaucagaaauuggacuugaaguuaguuuuauucucaggccagccuucuccaguagugauaaagauggccaccagcaacuuugaccugccaguuuggcaaaaugaucagaaaaguguaaucuuagcuccaucagaaggcccaggaaugccucucacuggccugacuuacgucaugugcccaucucugcaccagccuguguucuuuggcagggcagggcuaaggaauacucuggccagccuuaguucucuggccaucccaggagccuggggcauagggucagccccaucaaaccagccggaccaaaaaaaaauuuauuuucuaacaguuuuauuuuauuuuauuuuucuuucuuucuuuuuuagagacagggucucacucugcugcccaggcuggagugcaguggugcgaucuuggcucacugcauucucucucccagguucaagugauccucccaccucagccucccaguaacggggacuacaggcacgugccaccaugcccagcuaauuuuguaauuuuuuuguagagaugggauuucgccauguuucccagccuggucacaaacuccugcacucaagggaucuaccugccucagucucccaaagugcugggauuacagauguaagccacggcacccaaccacacaaaauuucuuaaaaacauaggacagggccagggagagauaagccaggcaaaaccacagguguguucuauguuuuuuaacauaguauauauauuuuaaaaagaauaaauaauuugauucuacagcuuuauccuccaaauagggaaugaguaagauacugugcuaaagcccuuuucagcccagaguaguuguagccuccugucuucuuacccugcuguaguuaccuugagcagacuugcuccccagcacuggggagaugauuccucaaacagcagcacuucauguggcagcaucuugaauccucagagaauucuuuuucacaacguccaaaguaaauauuauuucaaacucuuacguuuaacugaacuguuuuuucaauuucaguuaauaaugacacucaguuguuucugugauguaccaaagauguaagaauacauuguaggauucauuagggccaacccugucuuuacuucucugauagcaguccauuucuaaaguacaacguacauuuaacuagcaccuuaaacuuacagaauauagcuaaguuauuaacaccuuuuuugcgcuuguccuuaaaacauuaaacauuugaaacaaguuacuuugucuauguaagcaaaacugcuaaaaacacuaguugguauuuguuccuuuuguagugaugccuuugugugcuauuaaugaauaauauaggcacuaaguaacuccccuguuacuacuguagagauuggagggucugggcugggggguagcaggggcacaccacaaacgucuucaccuccaugaagcuguguggugacacagggaacuguuuagguucccacacaccaguucaguuauuauaguguauuuagaaauuuggggauagugucauucauugauucuacaaugcccauuuuuuccuauuucagcuccucugaauucaggauguaucuuaauuaauggcaucagcaauucagugaaaucuaguuguugccaacaacugaucacggguuuguuauuuaaaaguccagauuucugauuucacuuuaaaaucagaauaucuggcaacagcugcccucauuccugcuuugaccuuuccuuuucuuuuuauuuaaagagagagggucucacuguguugcccuggcuggacucaaauuccugggcuuaagugauccuucugccucagccucccaaguagcuaggacuacaggugcaugccacugcacccggcuguuuagaccuuuguauuauggaacaugggcugacugauuccccauguugaucauuaaguccaguaaacugguuugggauuaccugcuuggucccuguagauauucaagaaacucuguuauuuuuuacucauuuuuagguacacguagaaacaccccaauuucaaagcuaauuuaucuguuguuuuuaaucacgaguccucuccuucugcacuaucaagugucuucuacuuccugcuuaagucucuguuguccauuucauuaagacagaaguuucuauuauuguuaaauuugaacuguaucuauguuauaauaguaaugguaacucaauccaaaggaccuaauaacaggaaguaacaugucuuacauaucaguuuauauuuguuuuuuuguagggacauacugugaucuugguauacuuguaauuuuuuaguuuccuggucgguucagugcauuuauuuauuuauuuuuuuaauuuuuguuuuuugagacagaguuucgcucuuguugcccaggcuggagugcaauggcacaaucucggcucacuacaacuuccgccuccuggguucaagcaauucuccugccucagccucccgaguagcugggauuacaggcaugcgccaccaugccuggcuaauuuuguaguuuuuaguagaggcaggauuucuccauguuggucaggcugaucacgaacaaaugaacuuuuuaaauugguugccuuauuaaauaguuaggaagauaguggaaagauauaucucuguaaguagguaaguaaguaaauauugggaagccagaaaccuaaguagauaguuuuucccccuuuauucguggagucaagauugcucauguuggaagccaguuagucauucaggaaaacagggaaguucccagauuccuuauacuggaaaaguuugcuugcuuucuuauuaauuagcagcaacuauaaugagaauugauucagauaaaauaaccaaauaguauauuuguauggcagcagucagcucuguauuccaagggcugauacccuagcaaugaaacacuguuaaaagaagaugauuaggaacaggauauacguccauucccuagauauacuuauagcagggcaaauugagauuccugucucauggcaauuuguaaacagcuuuuccgcuaaagcaaaugaguuugaaguccuucagagacucagucuugaguagagagguuguggggagaauacauuuaaaaacgaauugugcuggucuuccccuugcagaaagcagaaaauggagauuuaaauuggauaauaccagaccgauuuauugccuucuguggaccucauucaagagccagacuugaaagugguaugugaaauuauggcauuaaucucauuuuguuauugaaaauaucuauccuauauuuucuuuugaaagaguuacaccaagcuugaccaaguguuaauuauuauuuaagcauacuuggucacuucaguagaucauucugacuggauuuuaacuuucuuuucuuuuguuuuuuacaguuauaaucaaauugguauuuaauucccaguccagauacuguuuccguucaguuacaggugaaacuauuagccauuguuuucuuuauguguuuuauaagaucuggugcauuucuuuauguagguuaccaccaacauucuccugagacuuauauucaauauuuuaagaaucacaauguuacuaccauuauucgucugaauaaaaggauguaugaugccaaacgcuuuacggaugcuggcuucgaucaccaugaucuuuucuuugcggauggcagcaccccuacugaugccauugucaaagaauuccuagauaucugugaaaaugcugagggugccauugcaguacauugcaaagguauguuucuaggggugguuaaagaauaguauacaguaugaguauaugaauauguagaaacagaccauauucauuuaguuuaugugucagaacaugaaacugccuuuauuuuuagagugccgugaaaccuuugauuucagaugaaaaguauaguaacuuauuuucauaaguaauucuacaaauacaucacauugaaaugcauuuauuuauucaucaaauauuuauugggugcauccuauauaauucuaggauacaucaaugaguagcguagacuguaagagccugucuuaauggaaacuauauucuuaacaaguugcucuguuuucagcaauuguaacagugccuggcacuuaauagauauuuuuugaauaaaugaaugacuauacaauaauaaaugguaugaagauaguaggauuuauuuaacucucuuguuaguuaauuaagaaacaagaaauauaguuuuguuacaaaaauccaauauuggaaaaaaagcucagcaagccuuggggaaagggggagacugaucuccagaguuacugcuguauuuguaguuuuaaauauaauggcaaaacaucacauuucaguuuuuauugaaaaauuacauggcauacaaagaaacaggaaaguauagccuauucaaagggaagaaauaaauccaggccgggcaugguggcucacgccuauaaucccagcacuuugggaggccauggcgggcggaucgccugaggucaggaguuugagaccagccuggccaaaauagugaaacccugucucuacuaaaaauacaaaaaaauuagcuggguguggugacggauaccuguaaucccagcuacuuuggaggcugaggcacaaaaaucacuugaacccggaaggcagagguugcaaugagcugagaucaugccacugcacuccagccuggccaauagacagaacaaaaaaaagaagaagaaauaaauccacagaagcuaucccugagaaagaucaaauuguggacuuaguaggcaaaaaauuuuaaauaaccaucuuaaagauacccaagaguuaaaagaauaugugggaaaagucaaggaaacgauuuaugaagaaauacuaauaucaguuauaaaaagaacacauaaaagggaaccaaaaggaaauucuggaaauguacuaaaacugagaugaaaaauucacuggagggauucaaaagcauauuugagcaggcagaagaaucagugcgugugaagcuagaaucauuaaagaauuagcaagucugaggaacagaaagaauaaagagcauaacauaaaugaacagaauuuaagggaucccugagacacacccaaguagaccaagauacagaucgugggaguuccagagggagaagagaaguaaaggagcagacagaugauuuggcugaaaacuccccagauuugauauaugcaggaauauccaagaagcucaacaaacuccaagcaggauaaacucagaggcccaugugaacaugcauuauaaucaagcuauaaugccacagacagucuugaaagcagcaagagagaagugaccuaccacauacaggggauaccacugagauugucagcagaucucucaucagaaacauugcaggccagaaggcaguggguugauauauucaaaaugcauaagugagggaaaaccuguuaagaauucuacaucuggcaaaacuccuucaaaaauaauggaaaaauuaagacuuugcccaggcaaucaguuugccuuucugauaaaggcaaauacauggaccauuauaaaagcuaguauuaucguaacgagauaauuuguaaaauauuauuacuguaacuuguaaauauuguaacuugcaaaaaacaaauagaaaaucugaauagaccccuaacuaguaaggggauuaaguaguccaaagccuccugacaaagcaaaaccuuggauauaauaacaucgccaguaaauucuaccaaacacuuaaaagggaguuuuuaaucacuagaucugacuugcaagaaacucuaaagggggagucuuuuagguugaaaugaaggcacacuagacaguaacacacagccauuugagaagaggaaauaaagauuucugauaaaggcaaauacaaggaccacuauaaaagcuaguuuuauuguaacaagauaauuuguaaaauauuauuacuguaacuuguuauuguaacuugcaaauauuauaauauguaaauuauuguaauuuguaaaauaauuugucguuugcaaguaguauaauuuuuguguauuauuauauacaaaaauugcaaguaguauauuauuguaauuuauaaaauagagaguagaaaaccaauagagaaaaugaacaaaaccaaggguugguucuuuaagaagaauaacaaaaaugauaaaccuuuagcuagaaugaugaaguauaaaaggaagaagacucaaauuacuaaaauuagaaaugaaaauggcauuaccacugauacuacagaaauaaagcugaucaguacguaaaaaugaucaguauuguaggacaacaaauuggauagucuacaugaaauggacaaauuccuagaaaaacaaaacaccagaacuaaaucauaaagaaauagaaaaucugaacagaccccuaacuaauaaggagauuaaguaauccaaaaccuccugagaaagcaaaacccuggacaugauagcaucaccaguaaauucuaccaaacacuuaaaaaacuaaaaccaguccuucucaaacucuucugaaaauuugaggaaaaaggaacacuuucuaacucaauaaggucagcauuacccugauaccaaaaacaaaaagacacuauaagauaacuaacuauaggccaguaucccuuacgaacaucgaugugaaaaccuugaacaaaauacuagccaauggaauucagcagcauauuuaaaaggauugugugccaugaccaaguaggauuuaucccaugauuacaagagugguucaacauaugaaaaucaaucagugugauauaccacguuaaggacaaaaaccauacgaucaucucugcacaaaaagcgucugacaaaagucauuacccuuuugugauaaaaacacaguacaaacuagguauagaaggagauuaccucaacauaagaaccguaugugaaaagcccacagcuaacaucauacucaauggugaaagacugaaagcuuuuccucuaagcucaugaagaagacaaggaggcuugguuuuguggcuucuauuuaacaugguaauggaaguucuagccaaaggaaguaagcaaaaaaaaaaaaaaucgaaauuagacagggggaaguaaaauuaucuuuuugcagaugauaugacuuauauguauuauagaaaacccugggccaggugcaauggcucuuggcuguaauccuagcacuuugggaggccgagguggguagauugccugagcucagaaguuugagaccagccugggcaacacggugaaaccccgccucuacuaaaauaccaaaaaaaaaaaaaaaaaaaauuagccgggcguggcgcaugcuaaggcaggagaauugcgugaaucugggagguggagguugcagugagcugagaucucgccacugcacuccagccugggggacagagcaagacucugucuccaaaaaaaaaaaaacagagagagaacccucaagauuacgcacacacacacagagccccugcuagaauuaauaaaugaguucagcaaagaaguagcagcauauacaaucaacaggcaaaaaucccuuguuucuaagcccugacaauaaaaauauaaaaaagaaacuaagaauacaguuucauuuauaauagcaucaagaagaaucaaauauuggggaauuaaccaaggagaugaaagauuuguauaaaacauuuuugaggaaaauuaaagaagauguaauuaaauguaaugacaucacauuugugcacugggugacuuaauauuguuaacaugucaguauugcccgaagggauauacagauucaaugcaagccugucaaaauuucaacauuucuugcaaaaauagaaaaaugauucugaaauucauuuggaaucucaagggaugccaaauggccaaaacaaucuugagaaagaauaaaaagguuggaggacucacuuccugguuuaaaacuucauacaggcugggcaugguagcuuaacaccuguaaucccaguacuuugggaggcugagacagaaggauugcuugagcccaggaguuuaagaccacccuggacagcauggcaaaaccccaucucuacuaaaaaauacaaaaauuaacuggguguggugguguuuaccuguagucccagcuacucgggaagcuuagauagcaggaucccuugaaccugcgagguugaggcggcagugagccaugauugugccauugcauuccagccugggugacguagugagaucccgucucaaaaaaaaaaaaaaaaaaaggcuuaguacaaagcuacaucaaucaagauugugugguacuggcauaaagacagauacauagaccagugauaggauagagagcucagaaauaaauccuuguguauauggucaaaugacauucaagaaggauacagaaaccacucaauggggaaaggacagucuuuucaacaaauggugcugggaaaaccugauauccacauguaaaagaaugaaauugggcccuuacauaacaccauauacaaaaauuaaaauggaucaaggaccuaaauauaggacuuaaaacuauaaaacucuuagaggaaaacagagggugaaaacuucaugacauuagauuuggcaguaauaugacaccaaaggcacugacaaugaaagaacagacaaaucggacuauauaaaauuuuaaaacuuuugugcaucaaaguauacuaucagcagaguaacaagguaacccauggauugggagaaaauauuugcaaaucacuucugauaagggauuaacauccagaagauauagagaaaacgccuaaaaacaacaacaaaacccaguucauaaaugggaagaggacuugaauacaccuuucuccaaagauauaaaauggccagugagcacaaguaaaguucucagcauuuuugacuuauagggaaagucaaaucacaaccacagugagauaccacuuuauacccauugggauggcuguuaucuaaaagaacaaaaacaucaccaccagaaaauuacaaguguggagauguggagaaaauuagaagccuuguguacugcuagugggaguauaaaacaaugcagcugcuauggaaaaugguguggcaguuccugaaaaaauuaacgucauucagcaguuccaucucugguuauaugcucagaaacaauugacagcagggauaugaacagauauuuuuacacccauguuguagcagcauucuucuucuucuucuuuuuuuuucuuuuuuuugagauggacuuucacucuguuucccagacuagagugcuguggugcaaucuuggcucacugcaaccucugccaccuggguucaagugauucuccugccucagccuccagaguagcugggaugacaggcacgcaccaugacauccagcuaauuuuuguauuuuuaguagaaacaggguuucaccauguuggccaggcuggucucgaacuccugaccucaaguaguccacccgccuuggccucccaaaguucugagauuacaggugugagccaccacgcccggccagcagcauuacucugaauagccaaaagguggaagcaauccagguuuccaucagaggaaggcuaaagaaauggcuaaagaaaaugugcuauaucauacaacagaauauuaugcaucuuuagaaaugaagaaaauucugacacauguacugccacauggaugaaccuuaaagauauuaggccaauuuagguuugccagucagaaaaggacagauauuguaugaauccaguuguaugagauacuugggguaagagaaaguagauuggugguugccagggccugaggggaggcagggauugguaguuauuguuuaauggguccagaguuggcugggcacgguggcucacgccuguaaucccagcacuuugggaggcugaggugggcggaucacgaggucaggagaucaagaccauccuggcuaacacggugaaaccccaucucuacuaaaaauacaaagaauuagccaggcuugguggugggcgccuguagucccaguuacucgggagucugaggcaggagaagggcgugaacccgggagguggagcuugcggugagcugagauugcgccauugcacuccggccugggcgacagagcaagacuccaucucaaaaaaauaaauaaauaaaaauaauaaaaaauaaaaauggguccagaguuuccguuuuguaagaugaaauacguucugaagauggauggugguaauguuuguacaacaaugugaauguacuuaaugcuacugagcuguacacauaaaaagugguuaaaaugauauucagaaacuuacacuaaggaaauacaaguuuccgaauuaaccaauacagaauuuuuuuguuuuuguuuuugagacggagucuugcucugucgccuaggcuggagugcaguggcacgaucucagcucacugcaaccucugccucccagguucacgccauucuccugccucagccuccccaguagcugggacuacaggcgcccgccaccgcgcccggcuaauuuuuuguauuuuuacuagagacgggguuucacuguguuagccaggauggucuugaucucuugugauccaccugccucggccucccaaagugcugggauuacagguguaagccaccgcacccggccccaauacagaauuuaaaauaacugucuuaaacauguucagugagcuaaaacagaauucagacaacuaaaugaaaucaggaaaaugaugccugaagaaaaaugguaaauuuuauguauauuuuacuccaauuuuuaaacauaauuaaaacaaaagccagcauugcuuauuucauuuuuuaauuauaaaaagcaguugaaggaauucuucagcaagguccuuuugcaccccaaccccaucacacacccgacauuuggcaaccugcagagaccuuuuuuggggguuggguaccacgggcaucugguggguagagaucagcgaugcugcuaaacauccuacagcgcacaggacagcuccucacuauaaauaauuauccagccucaaauguuaguacugcugagguugagauacccugaaauagaaugaugaccaauuaaaagccuagagaggaucuuauuugauugcaucuuuguuuagggaagaaaaaugaugacaguaugaaaauugggcuguacagugaaaauugagauucauuaagagguauauuaaucugcuggggcauaucaccaacuggguggcuuaaacaacagaaguuaauucucucacaguucuggaggcuagaagucuaagggcaaggcacuggcagggauguuuucuggggaggccucucuccucggcuugcagugcagaugucugucaucucugagucuucucaugguuugcacuuaacuccugccgucucuuucuuuuauuuuuuugagauggagucucgcucugucucccaggcuggaguaaaguggcgcgaucucagcucacugcaagcuccgccucccggguucacgccauucuccugccucagccucccgaguagcugggacuacaggugccugccaccacgcccggcuaauuuuuuguauuuuuuaguagagacaggguuucacuguguuagccaggauggucucaaucuccugaccucaugaucugcccuccucggccucccaaacugcugggauuacaggugugagccaccgcacccggccuaucucuuuuuuuucuuagaaguacaacaguccuauuggauuagggccccacucugugaccuuauuuauuuccguaaaggccuuaucugcaaauacaguuguauugggacuuagaacaauauauggauuuggguuaggggggacacaauucaguucauuauauucugccaucuggccccccucaaauuuaugucccuucacuucaaaaauacauucaccccaucucaacaguucugaacaucucaauucauuccggcaucaacuccaaguucagagucucaucuaaauagcauccaacucagguauaggggagacuugagguaugauccauccugaggcauaauuccucccagcugugaugggaugguacaggcacaggauagacauuaccauuccaaaagggagaaaccagaagaaagagcuucuaagcaaguccaaaaccuagccaggcaaaucccauuacaucuuaaggcuagagaaucauccucuuuggcuccacgcucugcccuccaggcccucuaggguaguggcuuugucccugagggcuguggucagaggcagcuggguuugcuguaacuaauagagguggcccuacccugugaaaucaaggaguaggcaggccuucccugagcuuauauacucugugucucgguggcaguggcagcacugggggucucuaaauugcccuugggaucauccuuccuuuucuugaaggacaaagaauguuugcauccagguagcucugcugucagaaguccaaaagccuuacuuuauuuuauuccauguccauccccuuuagugcaagaugccagugucucugcugguauaaucccaucucuuguccuugcuucugcugagauggcugauuaagucuagguaaucucuuuagagggggaguguccagccacacccuugacuuuucucucuguaacacucuuauuuuuugcaauauggauagccugagaauuuucugacucuaguuccugauucccuguugcuuaacaauuucuucuuuaauucgucuuuuuccuuuugcauuuuacaguaaccaguaaggagaaaccagguuguaucuucaacacuuuccuuacaaaucuccccugcuaaauaugcaagguugucaaucacaaagccacuucuccauuucuauguaguuguuacagugaccccuaucucaugauccaaaucuguauuuaggguucuccagaaaaacaagcaguaggauuuuuuuuauauguaggagauuuauuaaaaggaauuggcucaugcaaguauggauucuggugaguccaaaauaugcagcgugggccagcagccuggaaacaugggagaguugauggugcagaugaaagccaaaggcagucucuugcucaggaaagucaggguuuuuguucugcccagguuuuucagcuaauuggauggggcccauccacauuauggagggaacugugcuuacugaaagcucaccaacuuaaauguuaaucuccaaagauucauuccggauugacacauaaaauuaaccaucacuggagguaaugauaauagucuagauaagacaggccagcaccaauagagguuuaaaaaaaucugagugaaaauggguauuacagaccagaaaacauaauuggaugugggaguaagugcaaaauuacaagccuuugguuuugcaaagauggugguaccguuuuucuaaaaugcccagggcagaagacacugcacuuacugagaaucauugcucagaaagugauucuccaccucggcuacacauagaaucaucuggaagauuuuaggaaucucuguguccaagcuaugcugcauaccaguuaaaucuaaauucuuggcguaaggccaggcgugguggcucaaguguauaauaccagcauuuuaggaggccaaggcaggcggaucaccugaggugaggugaguuugagaccagcuuggccaacauggugaagccccgucucuacugaaaauacagacauuagccggcugugguggcacauggcuguaaaucccagcuacuugggaggcugagguaggagaauugcuugagcccaggaggugaagguugcagugagcugagauugcaucauugcacuccagccugcugggcaacagagugagacuccgucucaaaaauaaauagauaaaugaaacaaauaauaaauacauuccggaugugagaccgggcaucaguauuuaaaaaccucucuaggugauuccagaguguaaccagccuugagaaccacuauugaaagaagcagagucaugagaagccuuuuaaaaaaauucugccugcccaacaaaauccuggaguacaucagcccaaguuucauuucugugcuucuuuauuuuccuagcuggccuuggucgcacgggcacucugauagccugcuacaucaugaagcauuacaggaugacagcagccgagaccauugcgugggucaggaucugcagaccuggcucggugauugggccucagcagcaguuuuuggugauguaaguaguagccuacgucuguaguucccagggaacaugugggguuggaaucugauggggaguggaauuuccuuuaguuuccaacaacaacagauaaucugguaggaagaaguuguucauguaucuuucuggaaagcucuauuuugauguuauuuaaaugcucuaggaagcaaaccaaccucuggcuggaaggggacuauuuucgucagaaguuaaaggggcaggagaauggacaacacagagcagccuucuccaaacuucucucuggcguugaugacauuuccauaaauggggucgagaaucaagaucagcaagaacccgaaccgguaaucaagccguuucuguugcgauguuguuacugcuuuaacugcuauugagaaccugucaggguauggagaaaaccguagguaaaauaauaaagcagcucuuggaugauugucaguuuuuuauauuuauaacccucucuaggcacuuuuuacccaaaauaguggaaacaagguuguguguccauaaaacuauguuuuacuuacucagcaggugcauaaaagguugugaagugagcucuucagccagaucuaccccugccccucaccccuuuuugccauuucacaacagcugauuuaggaaagcaaucauucucaaauagagagcuuuuaacaaaucaaaggcuuaggggguagcaguacuacuacauuaagugguaguaaguacacugagauuuuaaaaagagcguuuucaaacuugaaagcccauuaacccucuucacuguugauguguuuucuaacaagagugcugcuguguugucucugaaagucaacuuuggcugucuuaaaaugucaccugaagcuugauugugaaagggaaaaauauucuagagcuugcagaaacuuggacuguguucauguggauaaauugcugcucugcuguacugcauuaauaagugcaacuuaaaucauuagcucaguguuuuuuuacuuacacaguacagugaugaugacgaaaucaauggagugacacaaggugauagacuucgggccuugaaaagcagaagacaauccaaaacaaacgcuauuccucucacgugagucuggguuccuuuguugugguugauguuucuucauaugugugugggguccuuggugaggguuuuuccuguacauuuuucuccauaguugcaagcccaugaugccacuuugaaaugcuugccuauguuauuuaaaaccuaggggugcuggccuuggaagcucucagcugucccuuguuuaccuugguccucaugagccuuuaugggugggaaggcgacaucagggauacuuuuucuccaugaauaaucagcauggggcauccucaggagcgcgacagcagauguaaagcccaggaugccagacuuguccauaguuacuaaagugguguauuucuuuacauuugccauguugcagaucauuuguuuugauaagcaugacaugauggcuuaaugacauuauguuguuuuggggcaacaaugaacuggucuaaacuauauuuuggguuuuucguuuguuucuuuggggaaugauuuucuaauuauagaggaagauuuagccugagaauaggaaauguuguaguacugaguguauguaugucuauguguacauucuugugaauguguguuaguugggauucaaccugauggagcauccaagauuguuagaaaaauaugcagaagcaaaguacaugaccaugguauuuuuuguaggcuguucuuuaguaaaugcucccacuuguugccauuggauuucuuccuucuaguuacuuccuuuuucauugugggacaccagauuuccagccuucuuuuuugcggggagggagugugauggacauagaucauuuauucaguaagcaucuuguaauaugguaaggaaguaugauauaauauaccauuuauauuggcagagaacagguuuucuuuucaauuaaaaguaauuccucacuagugucucgucauaaaaauucugaaguagaauuacaccuaaggcaugugucauuauggguugcuccccugggagguucuucuuaaaagacccaaggcaaagaauugaguuuuacaauaugcaguguuaugugaaugaauguagggcauccauuuugauuauaggcauuuauuaagcauuucuuuugcaacuuagugguacuuuagucaacuauacuuuuuuaaaaauggugccuuuuggccaggugugguggcucaugccuguaaucccagcacuuugggaggccaaggugggcagaucaccugaggucaggaguucaagaccagccuggccaauauggugaaaccccgucucuacaaaaauacaaaaacuagccgggcaugauggugggagcuguaggcauuauaggaucccagcuacucgggagggugaggcaggaggaucgcuugaacccgggaggcagagauugcauugagccgagaucgugccauugcacuccagccugggugacagagugagacucuaucucaaaaaacaaacaaacaaacaaaaauagugccuuuguauaauuuacuuaacuccaaaugccauuuuguuuuuaauuuccuuauuaaaagucuucaccuaaggccuuaaugguuuuucuuuggaaguauuaugguggcuccagguaaucauccagauacuaauucuggaugugguggaggaggcaggcagcacccucgagcagugcuucucagacuucagugugcaggaggcacccgggcgcuuguugaaauauggguuaugauuggugggguggggguggggcccaagaguucacauuucuauccgaggcugcugguccagggaccacacauugaauugcaagcccuaggaaacugaugcuuuuguggguugauuuuagcugugucugggauuuuuuguuuuguuuuucagaaucagcaucaucaguuuauguuuuaauauuuuguugccugcuguucaaaagucaaguugagagucaggggauacaaauccugcuuagucaaaaguuuuuguuaaauaggaaauuuccuuuagucacccucugaaucugcuacucucauuaacgugaguucaaaucuagcugggcguggcugugcgcaccuguagaccaggcuaugcgggaggcugaggcaacaggacuacuugagcccaggagucugaggcugcagugagccaugaucacugcauccagccugggugacagagugagacccugucuaaauaaauaaguaaaaucaaguacaaugguaaaaguuaaaaaacaaagagguagcucaggauuccuuuugguaauaucccaaaaacaauauauauaaauagccccacauaacacaaauaacaaaguuuuaggccacacuuuuaaagaagaaagcgaaaugcuaguuuuucuaagcucugaguuauguguauagacccgaggggauuuuugaugagucucagcaaaucuccuuccuccucccuuacaacauuuugcuuauccccgucucugcuuuuucaaacccucucugcuauuauuugcaguuuuuuggcccuagaaaagaucaauugaagauuuucuuucuuucccucuugugucuauguuguuauuuuaggaauagaagucccugagggacuguucucaacaguugcuuggguugaaaaauacaaaaucaauuucuucauccaaguuugacucauugauuucugugagcaaguuauuuugcuuuagcauuggcacuuagccuuaugaaaauacaguacaugcaagaaggaaaguuagugagaaauacacaaguacuagugauucuuaggagaagguuauaguacauaaaauauuauuccaaugauugguuucucuuuuuuuuuuuuuuuuuuuuuuuaagacagagucuugcucuguuggccgggcuggagugcaauggugugcccucggcucacugcaaccucugccucccagguucaagugauucugcugccugagccuccggaguaucugggauuaugcaccaccacacccagcuaauuuuuuguauuuuuaguagagacaagguuucaccauguuggccaggcuggucucgaaauccugaccucaagugguacacccaccucagccucccaaagugcuaggauuacaggcaugaaccaccggcgccuggccgguuucucuuuuauaaauggucaguuuugggggagaguuuaaguuuuuagugauuauaaaauggccauuugcucagccugucugauccugacuacaaugaugacaggaaaccauguggcaccaugacauugagcugaucuucaggacgugaugacaaguauauugucugugcuaaaauggauuugguagauugcauaacuugagccaugaggccugucguucugcauacugaugguuuugguagguuuggagaugaguauaucuguuagcaauggaaaauaauucuuuuuuuauuuuuauuuuuuauuuuuauuuuugagacagaguaucgcccugucgcccaggcuggaguaaaguggugcgaucucggcucacugcaagcuccgccuccugggaucaugccauucuccugccucagccucccaaguagcugggaauacaggcgcccaccaccacgcccggcuaaauuuuuguauuuuuaguagagacaggguuucacuguguuagccaggauggucucgaucuccugaccucgugaucugcccaccuuggccucccaaagugcugggauuacaggugugagccacugcacccggccggaaaauaauucuuaagccaugagguuuacuagaggaaaaaguaaccaucuauaaugcugacacuuggacauucgggccauucugccuuuaaggaacugaaggugaaggcugggaucgguagagaguucucuagggcucccagaccauuuauucauuccauuuaaauauucaccccugugaucuuuauguauauuaguagcuuguuuuuuuugugggaagauuaaauaagaugguguggguauaacuugugggguaagguuaggcuguauuucgaguucacccuuuagucuaaucccuuuccacaauauaggaugccuggcauguaauuucuuuuuccccgagacagagucuugcuuugucacccaggcugggguacaguggcguaaucuuggcucacugcaaccuccaccuuauggguucaagugauucuccugccucagccuccugaguagcugggaauacaggcacacgccaccacgccucgcuaauuuuuguauuuuuaguagagaugggguuucaccguguuggccaggcuggucucaaacuccugaccucgugaucugcccgccucagccuccuaaagugcugggauuacaggcgugagccacugcgccuggccugacauguaauuuuuaaugaugacagugaugaggucaacaauaaaaaugacaugauaagccaaaucagccauuuccaaauugauuagcaguacucugcacacagcagaugcucaguagaggcucuaauauuuggucacagauguauccaggugaccauuuggaaguauagucauuggaaagagcuucugcccuuccaaaugggaggagguuuccuuccucacugcuagaacccagaccaauggauuaagaaacaccaagcugaggcuggacacaguggcucaugccuguaaucccagugcuuugggaguucaaggcagcaggaucacuugagcccaggaguucgagaccagccuggccaacauagugagauucugucucuacaaaaaaaauaaaaaaaaaaaacugggcaugguggcaugaacaggcagucucagcugcuacucaggaggcugaugugggaggauugcuugugccuaggaguuggagguuacagugaacuaugauaacgccacugcacuccagccugggcaacagagcaagaccccuguuucuuucuuucuuucuucuucuuuuuuuuuuuuuuuuuuuuugagacggagucuugcucugucgcccaggcuggagugcaguggcgcaaucuuggcucacugcaagcuccaccucccagguucaugccauucuccugccucagccucccgaguagcguggugccugccaccacgcccggcuaauuuuuuguauuuuuaguagagacgggguuucaccauguuagccaggauggucuugaucuccugaccucgugauccgcccgccucagccucccaaagugcugggauuacaggugugagccaccacgcccggccuuuauuuuuuuuuauuuuuuuuauuuuuugagacagagucucgcucugucggccaggcuagagugcaguggcaugaucucggcucacugcaaccuccgccucccgagcucaagcaauucuccugccccaacuucccgaguagcugggauuacaggcauaugccaccacgucuggcuaauuuuuguauuuuuuuaguagagacgggguuucaccauguuggccaggcuggucucgaacuccugaccucaggugauccaccugccucagccucccaaagugcugggauuacaggcaugagccacugcgcccggccgaccccuguuucuuaaaaauaaaaaagaggcagggugaggucaggaguucaagaccagccuaaccaacauggagaaaccccaucuguacuaaaaaugcaaaauuagcugggcaugguggcacaugccuguaaucccaguugcuugggaggcugaggcagaauugcuugaacccgggagggggagguugcagugagccgagaucacaccacugcacuccagccugggcgacaagagugaaacuccaucucaaaaaaaauuaaauaaauaaauaauaaaauagagcucaggugcgauggcucacgccuauaaucccagcauuuugggaugcugaggcaggcggaucaccugagaucaggaguuugagaccagccuggccaacguggugaaacccuguauuaaaaauacaguacuuagccgggcguggugaugugcgccucuaaucccaacuacucaggaggcugcagugggagaauuguuugaaccugggaagcggagguugcagugagccaaaaucacgccauugcacuccgggcugggugacagagcaagacuccaucucaaaaaauuauaauaauuaaaaaauaaaaaauaagaaagaaacaccaagcugaaagccaacuaguaugaggaaaaugaguguggaaaacaacuaagaaaagucuauaguaugcauaccuaagugaaauuuugcucauuuuguguugcccuggguuaaaugugaaccauauuauaaaaaugugccauucccuuagcuuccuggauggcucaggaguuaguaacucccuugaagugagaucaguucugcuguauuacguucauuuuuaguugugccuccugugauuuuguuaacuagucugggguuuuguguuuuuuuguuuguuuguuuuugguuaucugguuuugccuccuuugccccuugugguuugcuuuaguuuucugugugugcacaucuucugcuuuuugaagaaccucaaucauuuaucugugacugauuucaguaucauaaaguuaaauuaacaugggguaguuaucucacuagugacugagucccaaaguaugaaaccuguuuaaacacagcauuuuuuuauucaacauaaaauggcaaaacuccauccuuguugaccaccccuuuguaucccuguugcuguuggcugggcuuuuagggugucuaaaauucacauauggcuugauugauugaugauugcguaauuuauuuuggcuucccaauuugaacaucuguucuuuccccuucaccccuuuccagauguccccuagcugugcugaccucugcacuguguaguguugucaucugguggauuguuugugacuacauucuucccauccugcuauucugucucgaugguuucagaacacaguagccaucaggacccccugacagauagcugcuguaagugucccguucuguuucucugccguugcuuacuucuggugccuagugugguucccacaaugcauguuuuucuccuugucagcuccuagcuuuguugguuugccuauuuucaaagguucuuuuucugaaucuuuucaauuaaugggauggugguggggagggaaggugggcuucacuguuccucucauagaaaggauauugaaaguaacauacguuguuuuaaaguuaugcuuauccuuaacauauuucaaaauagcaguugauaaagacacugaaacaguuuuucuucacugaaacaguuuuucuucccuaucaaaaguaguuagcuuaggauaauuggggugguuuuauuuucgucaguuggcuauacaauuucccucuaguuuucuguaucuugaguauguccuucccagucuagcaaagaagcauuuuucccacugaucuacuuucauuaaauaugugauuuuguagccucgaaaucugccauuguacagcagcucucucauaagucuucucucuuuagugugcagaauuuccugcucugucucauuuuccuccuccccuuuagggaauacaguaaguacaguguguagcacuugaugcuaaaugaaaguaggaggucggagcugaggucgccuguuuaaauuggugcauuuccauaugauggucauuguuccugcuuuucuccuugcccagacauagccagaaugccuuuaauaggcuaauagcagcaaaucuguauucucuugagaucuuucaucuuugaaaugaagaccuuaacagcgaagaggcuuuauuucugcagaagaauguacaagaggcccacuuguggaacagcauguugaagacccccagaaggcggguguguccgugucacgggguccaccgccacccuucugugucugagcugcguucuuccuucucugaagcuuuuuccuuaacucauauuuuaagaauuucuucucuugucuccucuuggacuuggaaguuaugaaagaaugcaaaaguuccuugcaagaucucuuccaaagaaaaauuccauugcaaccaacucugguacuuugugguuucacugaguauuuucacauagcugagaaagauuuaaaaaucaagcugauuucacucuucagaauuaggcaaaaccugcuuaacuugcuccuauuuauggcauuuucuugaauaucuuacaaauaaaagcuuauugucgcgcauucagaccugcuguauuucugagauagauuaaccuuuuggguguuuucuucuuuacuucucuuagucaacuacgauugccacauauucugacucaagagcaucaugcacuacauagaguuauucuucucaaacuguuccaaguggcaaagauguucugaauggguggagcaguugcaaauaaugcuuaggcacuuugugguugaaugaucauucccaggguaaguuuaaacauggucucuaucaggcucucuucuuuucaguauuccauguaaacuauaccuucuguuguuauugguaaugacguuugccauuguauuucuagacccaagcagaguauucaguucagccugacuaauuauuuggaauuuugagaagcaaaaagcuugugacaguuacagugguguuaaucaguaucaucuuuguagcacccccaugucuuucucucaaaaggguuuuauuuguaagguggugacuccugagcuccaccauccucugucaucaccacccaccucugcuggcaguggacgcaggugguguggcaucgucugcuaaguuguuuccagugaaaagcuccuguuaugcagcaugccuggagaauuaggccauaacaacacuucaggcuucugagucagacucagagauagugggaaagccuucucuggaggcugcagggccucagggucaccuuugugcacgcucuugugguguccggaguggacagccaguauacauagugcauaguugcccugauggauuuuuuucuuggaauuggacauuuauguucgagaccuggcuuuuuaguuuuuggcuuugccguguuccuuggguugcagauuucacuauaucugaaaucucagaguaccgaggcuccaaggaugcugcagagaagaaggugaacuggaauauaggcaagagguagguaggauggaggauuuugucagggcagaugggaaggaagaaaauacaucugcugcacacugcucugcaaagccaugcuuggccuggguuggaaggcagaaggccgcgagugcccggguucccugugacagaggcaacacgucacccucuggugccugucagguggugugugcugucacucaugauagcucaguggaguucucccccaaccccgauuucaucagugcauaaccugcaguuaggauaaauaccguguugucagugcaaauaacuggagucuuccguggugugguuaauacacucaaguucuaucauucucuugguuuuaaaguuccacagaaauuacuagcuauuuaauauuauuauuauauuaguucacuuuaauuuacacuaauuuuauagagaaauaaauacuuuuaaaaagauguuuuccagcagccugagaaugacuacaggauuuagcaguagugucuuguuuugaauggcauuuaaacacuucagucauaguuuuaauuugagaaaucaggauucagauuuccuaagcaggcaguguaucagcucuuguuuuuuucucagauuaauuauuuugcagugugauuguugucuguacuuuuggccaaccguggccucaaauuauuugagaauuagguguuguauuuaaaaaaaaaaagccaacaggagucuuguuuucuccgugcguaagggaguggccgaggggagcggaugagaacaguggcagcacgagugccccggccugggcuucagaaguagcaaugaagcagcagcaguuuguuuuguuuuguuugguuuuaugcaaaauucuauauucaaauucuuagcagagaugaauaaauauuuccccaucacuuuauauaaacaaauaauuuuuagggaugggcagacuggcucaugccuauaaaucccaacacuuuggaaggucgaggaaagagaaucacugaggccagaauuuugagaauagccugggcaacauagcgagaccccaucucuauaaaauaaaaaaugaaaaaauuagcugggugugguggcauguaccuguggucccaacuacucuggaggcugagguaggaggaucaauugagcccaggauuugaggcugcuaugauugcgccacugcacuccagccugggcaacagagugagacccugucucuuaaaaaaaaaaaaaaaaagaaaaaaaauuuuaaaaacaauuccuuguuuuuagaaguagaauucacaagccaggguaauaguugucuuuaaucauacaauuaagaugcauauacacucuucuuuuuuuuuuuuauacaaagucucuaucaccuggcuggagaucggugacacaaacauggcucacugcagucuugaccucccaggcucaagugauccuccuaccucaaccucccaaguagcuggaaccaaggcacgccccaccacgcccggcuaauuauuauuauuauuuuauagagaggaugucucacuauauuuuagaauuugggcuucuuaauggugucuuguuucaugacugaaaaucugagaagcuacuuuuacuuuugggcauaaagacuuguuuggcugguggauuucuuuggugugggaauugcuuaaaauguccaggcuggucucgaaauuuuggccucaagugauccuccugccuuggucucccaaagugcuggaauuacaggcauaagccaccgcaaccaccuccuuuuucuauuuuguuagaacauucaacauaucagaugaucacacucuaggagaauuucugaaccaaacauuggcugauuuauccaggauucaugucccucugugagacagaaagcuaguuucauggggcccucagaaauccugcaugaguaaagugaaauaguggggaaagcugcccauccccuucuccccagaaggcuugggaccgcuggcccagacaagcuccagguuaugcucugguugcggagucucgcucuuuggcccaggcuggagugcaguggcacgaucucggcucacuacaaccucugcugcccagguucaagcaguucuccugccucagccaccugaguaguugggauuauaggcaccugccaccacacucggcuaauuuuuguauuuuuaguagagacgggguuucaccaucuuggccaggcugcucuugaacuccugaccucgugauccaaccaccucggccucucaaagugcuaggauuacaggugugagccaccgugcccagccucuuguugcuuuuuuagugaugagauguuuagcauuuuacuaaauguuggauaugcuuugguuugggucaugcuaagguuguagaaauuuauuaaucuuagccuauuuuaaggcccugucuuugguauauuagccagcauggugguagcugaggcccgugaggugggaugcucacuaauuguaaugguucaacuuuuuacuccuuugagcuggguucucauaaguuguuauuggcuuucucaccuuuauguuugaauaggagagaagaaagcuuguuaagucaguauuuucucuuucagagaauuaaaaguugguaucuauaaauguguguauauguguuuaguuugucauugauuaucucuugaagaaaagaauugcauauaggccuggugugguggcucacaccuguaaucccagcacuuugggaguaagugaggugggcgaaucaccugagaucaggaguucgagaccagcuuggccaacauggcaaagccucaucucuacuaaaaauacaaaaauuaaccaggugagguggugggcgccugcggucccagcuacucaggaggcugaggcaggaggaucgcuugaaccugggaggcagagguugcagugagucgagaucacgccacugcacuccagccugggcgacagagcaagacuccaucucaaaaaaaaaaaaaaagaauugcauauaaaaucuuuugaugucuucugcuguuuucccuauaacaauuuaaagaggaaagaaaaaaaaaaaccaaaggaccaucugccucuuaaaggacauuccguguggccuuuaucucaggauguucuuuucugauucaucgugugcuuccuccugggcagccuacucucauaugcaccaguuucucaagcuuuuuagaguuuaauuaaggcaagcuuuacaaaauuuaaguguuuucacuuucauuuuaguggcacuuggagauuuaguaaguguuauauauaauucaggcaaaacucauauuuugcuuaaacacuuucuaaaauuuugaaacguuauauaaaauuaguauugauuuaguggauuauuacccauacuuacagcuuugaagagugaauauuguauaguuauuuccuaaauuuauguuccuauucuuuagaauuugagcucuuaauggugucuuguuucaugacugaaagucugagaagcuacuucuacuuuuguugggcacaaagauuucuuuagcugguggauuucuuuggugugggaauugcuuaaaaugccaagucauucgccuuccaggagcaaagcccucugguugucuuuguguaaccuucaaagagaaacgagaugcuucauuuuaaaaggccuugaugugaaaauguguuucagauuuuuuugguaaauguguugauggaaaauccucucaauucucaagauaauuugcacuaaagugcaaaaauacuuuccucugucaaguauuugcaaaugguuucagugaauauaaucuuauuuuuuuccaacuauuuucagaguaauucuucaauccaguguucagagcuguaaaacaucugaaccuaacauuucuggcagugcaggcauuacuaaaagaaccaccagaucugcuucaaggaaaagcaguguuaaaaggugagaaaagaauccuacucuucugaaaaguugcaagcguuuguuuuccaguuuaauauuuggacccuaccucuggagacugacaugaaauuaggagaaaguagagucucugugaugggaaauucaucaaauguguauuccuuguucauuaucuaagaaaaucuggaccauuuuaauguaggcuuuuguuuuguuuuuuagaaguaauucucaacacuggaaguauggucucugggucaugauaugggaaaguuuuaaguuaagaauuuccaaagcuggcugucaggacuuggaggacauuuuucuagguguauaucagauacagcaucauugcuggacgauuagcugcaaaugaaugugaugguagaaaugagauaaccagagaguuugaagauccuucucuaccuagugacucuuuguccucuuggccacagcccacacccgaggcacuaguucuuucacugucgucacugucuucagugaguguaggcagaauuucacaaggaaaccaauguguucuguggccacgucggugacucuguugucuuuggauauuucucaugaaguggacaugucauuuuuaaaguauucugaaaacagaucccaucugaagagagaauaaauagcccaggaguggaaguggggauagauggcucaggaguagaagggggcaccuuuucaucguugccugguguuggcagcccaugcaguccuguuucuguccuccugguaaaaacgaucucuucuaauagacaugagcgaccugaagauaaucagaaccagacuuuaaaauguccugcacguguacccugcuucuuuucagcuucccugccauguauauccgaggcuuugggccuaggggccuuaucagugugaaauuaguccccagugcaaagcagccagucucccaagagaccuuggcagagcugggaguucugugugcuuugccuuuugaagacucauucagcucugccaugucuccucuacacuguuuuguacaaccuuacugcacacuuaacacucgcauggggaugcagcagugccccggcauaaggauuggaggacugucaggcacugacucaugauuccaggauuuaaaauuuuucauuagaaauguaccaaauauuccuauuucuuuacuguuugauucuucuugagaagaauauuagagaaauacugaccaaaggucaaagauuucgguacauuggaacaauagcggaguguuauuuauaacagugagaaacaggaaaugggcucaagauuguuacauuaugccaaaugaauugggagucauacauuuaguuuaguacacgaagcaguaagugaaaagagccaugcauaacaauucugaaguaugggccgggugcgguggcucgcgccuguaaucccagcacuuugggaggcggaggcagguggaccacuugaggucaggaguuugagaccagccuggccaacauagugaaaccccgucucuacuaaaaauacaaaaauuagccaggugugguggcaggcaccuguggucccagcuacucgggaggcugaggcaggagaaucgcuuaaacaugggaggcggagguuucagugagucaugaucacaccacuguacuccagccugggcgacagagugagacucugucucaaaaaagaaaaaaaaaaaauucugaaguaugacucuaauuuuguaagcguaaguauacuauauauguauagaaauauagagauguauaaauauuuauauaccuacaauacaucuguauuuauagaugaguaaguuucuauauaugcauagaaauaagacaggaaaaauaugcuaugauacuaauaaaaguucugguuggugggacaguugggauuuuuuucuuuuuuaucgucuuauuuuccaauuuuucuacaauaaaugaagggaaaugggaguguuuuaacugacacuuuuuggugagccaagcuauuaaaaauucaggcugggcgcgguggcucacgccuguaaucccaggacuuugggaggccgaggcagguagauuaugaggucaggaguucaagaccagccuggccaagauggugaaacucugucucuacuaaaaauacaaaaauuagcugggugcaguggcgggugccuguaaucccagcuacucgggaggcugaggcuggagaaucacuugaacuuuggaggcggagguugcagugagcugagaucgcgccauugcacucuagccugggcaacagagcaagacucugucucaaaaaaaaaaaaaucaaauaaaaagccuaucguugaugacaguuaauuguuaauuuugacaugucuugaaggggcauauucuuuuuagguaugagugcucaggcuuuuuuuuuuuuuuuuuuccuuugacauggaguugcccaggcuggagagcaguaguguuuucucggcucacugcaaacuucgucuuccagguucaaaccauucuccugccucauccucccgccucauccucccaaguagcugggauuacuacuuguggguggcaugugccaccacaccuggcuaauuuuuguauuuuuaguagagacgggguuucaccauuuuggccaggcugaucuugaacuccugaccucaagugguccaccugccucagccccccaaagugcugggauuacaggcgugagccacggcgcccggccgcucaggcuuuuguuaacagcguagugugucuugcacauuuaauucugcuguuugcuuuuuuagauuaugcuuuuuagguuacagaagaguagaguccgggagccuggcuggcacuugccaggucauaucgucuuccugugaggaaggaagggcuggccuugccucuguuuuucuaucuaggucucguugcguuuucaugucacucuaguaaccugaacuccugccucucuggagaagugguuccugguugcagcaagcaucugccucaggucccuggcagggaugcuuugaggguccuaagguagauuucagagucaguaaucuggacugaauguugaaaugacccaaagcagcuuccaggaauuugggauaguucugaaaaccaaaaagacuucuuuuaaauuccaaaauggacuuucagagaugauguggagagcaaaaggagucuaacagugaggauuaacugggacucacaguuuauuuccccaccuuccucuaaguggguucuuucuuugugccucuuuugggacuuuguccuguguucacaucacccuaccuguuauccaccuacagcuuacaaaagaaaggcaaauuauguauagguuuuaagaauuggaguuagccaagcuguagccuggagcuuuuauccuacugaauauuauucauaauaucauacuaaauaguauucauuucuguuuggagggcaagagggaauuaguauauuggugcacggucugauucuggacaaaauaguaugagcuaagauuguugaguaaauuuaaaguauugaguugaaaucuuuaaacagcaguagaaaaaaaaauagagcacccuuuugggguccuuucaucccuaccugcaacguagcagguuuaccaguuccuacugguuugucaucaucucugcggcacaugggaacuugaccuuccauuuucauguuccuuggcauccaggaugaagacuccacccaaacucgcuuugcgcuuaauuggugcuuuugauuuuugguuuuacugagaggcucuucagcuuuggggaacuuuuucaaaaacgucaaaagagcaauuacuuggggcagcugaaaaaauaggagugaugucuuaacuauuugucuuugggaaaaggugccacuguuucucacagaagaugacuauccccucguguauccauuugaagcugugccacaucgaaaccuaaaucucauguggccacaggucugggacggcggccaggcagccuguguggcccucgguccugccagggcucuguguggcaccuucucauucccuucccugagucuggagagggaggugagugggcuucucuaccucccacuuccuguuagagcuauaaauccaugcuaaccuuucucuuuuaagaauuaauaaauccagugaauaauuggcuccguugaaucggccuguuuucaguguucucacaugaccucucugaagagcucucuuagaacagucuuggaaauuucaucaugccccgagugagagccugcagccaccucauuugcucgcauucacucaugucuucacgcagcccuuccgcuggugcguguuuguuagcuuaugcuguuucuuuugggcaggcucuucuuuuuuuaaaaugauaacuucauucauuuucuaagaaacuggcauguacaaguuacuuuaauucugaguuguaucacuaggaaccaucacuuucugcugcagcugccaaaccaaaccuaagguccggggcucuggagugcuuuguaccuaauucuucauauugugggggcuggggagagaaaugcucagguucuuuccuuagcaucuuuuuuuuuuuuuuuuaaaugagacagagucucacucuguuacccaggcuggagugcuguggugcgaucuuggcucacuacaaccuccaccucccagguugaagugauucuccugccucagccuccugcauagcugggaauacaggcgugcaucaccacgccuggcuaaaaauuuucuucuguauuuuuaguagagaugagguuucaccauguuggccaggcuggucuugacuccuaaccuuaggugaucugccugccucggccucucaaagugcugggauuacaggugugagccacggcgcccggccucuuuccuuagcuucuaaaaccacgaguguuuucaggagcccuucaguugggagcagcugcaucuaggaccucuaacuucuucaguguucucggguggcuuugcuggugucacaccugccacugccucuugacccucagagucucagaucugggcaccuguuccguugccucuggguguuaauuuuuggcuacugccauuaucuccaaaguccaucaggagaggagucccagaagguugucuccaaauguuucuuuguaaaauacuguuucucuccaguguuuuaaaauauuaaugauccuuugaaauuccagauauuuucccacuugucucacuagcuggucuggaucuuugacucagugcucuguugggaucucugaaaacgaaaugaucgauucaaacgcuucuccuugaagagcgcagcagcagcagcaucgggcgaggagcccuccagauuggaagugguuuuucugacucuuauuuugguuuuguuugcuuucugaaaguuguuacugaccugaaaguguagcgucgugaacuggggaaggagagaagagaggcaggaugagaaucguggagugcggaggcagguagcccguggggugccuccugugcucgguggagcuggaagccgcuuaggugccagagcuuuuucugugaccaaauucuggcuuuugaaauaacccaguaacaguucucuaucuuuucauucugcccgcuccucccacagccuggucccucagaggaaaggaaggacaaggagugcuuugcagcacgugccccuggcggcgucaugguacuuuccuggcccugcugccccugcccguccgucuuuuaugauuuuuauuuacucguauugguuuuuuuaaauuucuauuuuuugcagaacugagccuuuuucugcccugccuuucuccuguuugucuuuccuuugugguugauauuguguugucuucuccaaaguauuugucauuagaaacuuacagcaagcguauacuuuuuagcaugucaguauuuuuauuauguugcccuccuugucuuugauaacugccuguggacgcuguguaaacuuucugguaaaaauccuuuuuuuucccccuguagucucuccauuucaaggacuaaaacagucuugcguuaaguaaaaaccugugaccagagcugaaggaagacucuaggacugaaaacugcaacagaaauuagcacaauuugaaaacaaaacaaaauugcaaaagccuuaguugcuuuuuccaccuaagaaguugaucaauggagaaaauguccacuggaguuugaauaaugaacuuugaguuugggugcaagcaaaugacucagagaaggguccagcucucaagcugaaugacaaacaugcuguuguaaauuuagucucagguguaaauacccaagcccucugguacccagggagcuggcuggucuguggugcaugugugucccugugauggcaaucauuguaguugcuggccuucagaagaauugaggaucugauggagguuuuuuauguauuuauuuucuguucaccuugugacccugugucaaaauuuauaaagauacaaaaggcauuacugaaaugguacuuucuguaauuugauacuauuuggcuuaaucaucuucacuugacuauuuguaauacuguuguaauguuaacucuguuaaguacccaagcugcuugucuuccaccaaagagugcuuuauuaacaagaaucugugaaaaucacauuuaaacacuguugcauguuguaagaccaggugguaccuuaguaaccuaaaacuugcaagagaauauuaaugguagcuuuagaagacucaggaggagaaacugacuucagaguuggaagauguugcaagucguuccuuuuucuguccuucagggacugaagaacugggaggcugcccauuguuugguugccagucauacaaauuaaaaucauauuuccuuccaugaauggaagaaacacacuauugguuuuuccccuuggaaacagcaaucccaaauaaugucggcuuacaaaaaaaaaaaguuaccacuuuuuuagaguccuucccuguaacauuggauuuuuuuuuucccuuaugagauccaccuaaggccauugacguggccugcgaucucagugacaaugaucugcuucuggaucucacuguugccuuugguuagggaacacaacuaguaacucugcagagugccuucucccgcagcccuacuggaacacagcagagucugugccaugaagcaguuacagaaacagaauugaugugcugcuaaaaaaaaaaaaaaaaauggggcccgaaauaaaagaauauauaguacucaccucaguuccuuccauaagaagugggugguuuaaugauuguuaagccauuuuugccugugccgggagcauggagggcugagaugucgacaggcagugggaaacaaaugcccuccuaagccacaaggcgugcgccagauuaguaggcaacuccauuuuaagaagcugccuuuuucacaaaacuggaagaaauaaaagcgguuggaauaaacaaguuaaaagucuuuaaugcaaaaaguaauugaaaggcagugccuccauuuugguguacuuucuuggaagaaaguauaaaauugaccggcaucaugagagacggaagaugccguguucucagccaaacaagcaacucuuuccccgccaggcacugucggguggggucaggccagcuuuuaaacacuggggacuggaucacagaaaaacagugguuuucugucccuggaaaugaauaggcacaaagacccacuuggcugugggcagacuacucuucaauaagauuugggugggaggaggaacauuccuuuugcuauuuugagcugagacaauauaaauauucaaacugugccaugcauaaagcauugaauucucagggcaccucuucuuccccuuaccccuuuuaaggccauccccuccauuaauaauaauccagguaguugugaaaaucgugcuucuaucugaucccuucuuaguuuggcuuuucaucccaucagaacaaguaaacguaggcgccacagcucuugugaguacugucucccucacggugaaugagccuccugguguuucguccaagaaaagaaagggugucacuggaaccacagcccuuuuucauuuuauaaacugccucuucauguugccugcucaaguuuccaccuagaauugcuaucacuguggcucuuucuaaaaaucuuucuauuuaacugguucacugaaauuagucauagaaaacuugugauuuggugaagaggcauuccuuguaauaaccaaaugacuugggauggugugcauagcaagggcaguguuacacuuaugaggacugucucuagcauccaggaagucucugggucugagggauggaaaguucuuccugcuaugaaugagaguggacucuuccccucacccccaacugaaaccacaaacaaccagaaucuucuggaauucugacuuagagucguuguuauagaagaccuuguugcuauggaacaugaaacugugugucagauggagagauccccuuaaccuaagagccuuaaauagcccugaaaguacacugggacgguuugcgauggaauuaaaauuggaagugaauauuuuuaggugcucuugaagcuuucuggggacucaaaauuaucaaaagucagggacaguccggaggaagagcgucugcaaaacuggguuccuagaaguauagacggacuuagcuuuuuguagaauuuggugaggagcagcgccucgugagagcagaauggccuggcguggccagugcuucccggcagcacgcagcucugcggccuccagaauuccccuguucugagcuugaugccccuagccuguccccuaccuacuuccuccccuccucucuagcccucucacaggggugauugcuaccucucuguuuucuugggccuaggcaaguuuuagaggaguucccaagcauuguuaugaggccagugugcucgcugggcugggcgggauggccugggcuuguguguggccugagggcucuccuggggccuucucuuuucccagucaccuuuggagccacagaagcagugcacucauuggaugucuguucuuaacacagcuucucuuucuacauuaaaaaaaaucauuauugcauuuuggaaagcagugcucaucaaaagcaacuuuuaaaaccuauuuuauuguuccuuuaaauguucucucccgcugaaacugcccuggagaggcuaucugcugcucuuccauuuacccacaucagguuauucuccaugucacucaguggagaugacuccagauguguuuaaagacuggacaauucaccuauacuguguaggaaauuaccuccuuaauuaccugguagaauugucagcagacauguucauccgaugauaguacugcaguuuucuauuaauaauuugcagacuuuuaucuaaccugcacucauguacagauuauuaaaaguuuuaaaauguaacugaucaguauugaucaaucauugucuugauuuuuuuuuacagcguauauuucuaaucauauuuuuuaaagccaagagaacugguugaaugaauguuuauuuuccugaagguauuuuuaagauaaagcuuccuaauggcguguaaacuuugcauauguauguaguuugauacauauugucacauuugaaaaucuuguggguuguaacugguuuuauacaaaauaucgaauaguggaaauuguauaauuacaaucauguaauuaaaaguauuaacccaa

SEQ ID NO: 193035 - RNA, 123674 nt, Homo sapiens
uaaucaauuaugcaagauaucccuugguuuuauuuuaacuuaaccuuugugaauacuucacaaaaauacacauacagaaguaaauaaaacuauacaguugaacuaaauauccagcagauacaacaaguagucagaaguucaaagauggauaaguuaggcagcugaugagguugucugcauaaucaaagggguagcacaaauaaugaacaaauaacuuuuaacaaaagcauucuaguuaacauaaaagaaauugguagucuauaaaaugguugaauggguaacaugcauugaucaauacaacaaccaauaauauuuacugaauucaaacuauuuacuuguaaacauuuaacaaagcauuaugagaucuaaauacagucuuugacaauuucaacaaaauaagucguauguuuaaaaaauaaagcugaugagcaauagaucauucuauauauuuucuuucaacaguuccagcaagagaaauagcagaguauuuuuuaaaaguauacagcaaagauuguuccuauuauaaugacaaacucuggaaacuguaaauacaaauaaucauugaacagucaaauggucauauuccuaaucaggaaguaguuacaguaagaacagucugcaauccaguuauacacaauugucaauaagaauguguuucuugucaguugauuucauaguucuuucucuaagagacagcaaaacuuuggcaacuggguguacugaaaauauauuuugaaaguucgagauaucaagauacagucauagcauuucguuuugugaaagguggucuguacaccaaggcucagagguuguuaaagauugauuccauguggaaauagugcaaauauccugcacagauagcuuacaagguugcuggcauaguuauucaccagcagaaucuuggauuuuguuugcauagcucacacaucacuggaauguggaaaagugugcuauuuuuuggcaagagcaaaggagacauuaaacugaagugaauuaccauguuggacaugcugaauccaugcagaacacuggggcgaaggcugcuaccugacaucauugguuuuuguauacugguuuuguuuuuguugaagcaguucuguuauagccagaagcuuuuucaauacgugcuagacagaggaaaaaugguaugaaaauaaaugaaagcucggucagcaauuucaggaugggaaccuggauuugaaaaaaacuguaucaaagcaaaaggaugcauaaaauauuaccacaauuccccucaaaacauaagucucuauuauucagucauuggcugaguauuucuggucauaacuaagagaauuuuuauacccuaaagugaacagaaauuuguuuguguuuggcaugcuccuauuuuuuaggccagaacuaucacacuaucacauguugucagaagcaguuuaucucucuuuuaaaaaaggcuuuuuuuauuuaauaucuaaggcaagucaagucauauuauuaguuuugaaagcugcggggggaggggcggggagaaacaggacuugaggauucuagaaucucagguuguagagaacucagucaccaaacucaaugcuuuaaucccuucuacaaaaucccugccaaaugguuagccagugcggugacagcauucacuaucuccugaaacuacauuagaaacuagucaaaacugucccuguggucacuuccucucaguagcccuuaugucagcugaggacauucaaaguguaacucauuuuguucuauaucuccaauaucuuaauugaccugguauuaagucccuucaaauucuggucuggucuuugaauacauccuuaucuguaucuguuuggugcagauggcagauagaagucuaucaauguagucuacuguuucucaaaguguaggccaugguucacuugcaucggaauaccuauaaauuccucuaagaguuuguuagacgugcagcuuucaaggccacacuucagaaccucuggaugugaaauuugacaaacaucccaaauaauaaucauuuguuucacaguuugagaaucacuuuggccaugcacuauaucuguaugugacagagaaaagacaagacagaaacugaaagaaaaaaaaauaaaaucaauauugacuuacuaacuagccauuuucacacaugcuaccaaaguguuauuacacuguuuuccaguagaauuaacauucagacucaagagcaaaaccugauguuuuucaguauuaaauguacaucauuuuagucggggcccguuauuucugucugcugagaucuuuuguaauaugaugcagagucucaaaaauuuaauguaacaagauaaaaauguuaaccagaauucagcuauuuauuaacucucuaaguguuaucuuugaaacaucauuguuaaugaaggcuggcgaaagccuaccugcugugcaccacgcucauuacugagcguucgaaguucaucugaaugagccacgcaaaucucaugcaaugcugcuaaaucacgggacagguccguucuagaaugcucuguaguguccggaaguucagguacauucuuuaagggaaucguaaaauugcauuuagaaauacaaaucuucuuuuuuuuuguuuuuuuugagacagaguuucgcucuuguugcccaggcugaaaugcaauggcaugaucucggcucacugcaaccuccgccucccggguucaagcgauucuccugccucagccucccaaguagcugggauuacaggcaccugccaccaugcccagcuaauuuuuuguuacaaauacaaaucuuucucuguagucucaugugaaaagauucuaauuggguauauuagauaauuuuuuuaauacucaaauuucucuuaaaauucuaaagauucuuauugaaauauaauauucaguauuaaugaugguaaaauauagacuuuguaaccuuuguauucacaugaaagccagauuccauuuuuuuccguagcaugacagauguguacaauauuauugcuauucuaaaaauaaggggugggggguguggcuuccuaacaauuagcuuuguaucugaaaaaaucuagaacauaugccaaauaguguagguuaacugcuaaucuggauuaaaugcagccuaaacuuaaaauuccuagaugaaauuucauuauuaagcuccuguaguuugucuaaguugauaaugcauauaaguaggaacugcacuaugaaaaugcaaugagaaccugucagguuugcaauuaucuguggacuaugcucagaauacuugcuaaugugugggaauaaucaguguuaauuaugguacuuucagauaagguucauaaaguaacuuagucacuauaaugaaaguuuauaguauagguugaauaucacccaaaaugcuugagaccagaaguguuucggauuuuggaauauuugcaguauacuugccaguugagcauccccaauccaaaaauccaaaauuggagauuuuccaaauagcauuuccuguuggugcucaacaaguuuuggauuuuuuagcauuucagauuucagauuagggauacucaaccuguacuuuauuaucgacacuaaaugccaguguuauuuuaagccuuggaauaacauuuaacaagggcuuggauuaccaguaaaauggugacaguauuugcuuuacauugcuaaaaacugcaaaacaauguuaucuaugggacagagaaacacaguuacucagaauacauucagugauuaaagguuuauagcgaugaaagacuccauauuugccuucagagaacugacuccaguagaaaggacuuuagaauaaaguaaucauagcaacacagaauuauauaucacagauacacaggggaugcuuaggagguaaaacaaaaguuauuuuauucauguuugggguucagcaaaagcuuccugaaggagauaauaauugaggugggucuucaaaaauaaauuuggcuuauuauacagguggugaagaaauaugguaguauuauauuuggauucuaagcaguaugaaaucuuagauuguguggcauaacuucucacacaguuccuuaaacauuauaguaaaaauauuuuccaaugauugaccaacuauaucccaguucacauauagaagcaugauggacuuuuagcauuuuuguccauuucacuauaaauuucacuauaaauauggagcuaugccauaauuuuucauacacuaguuuuuauaccugagguugcaaacuagugacucaacggcauuccugauuuguuugccacaaauugugguggucuuuuuaacugaaucugaauacauuaagacagaacauggacaccucaaucuccaauccuagcacucccuaaugccaugccuuacaccuggcucuauucacauguacaugcaccuuccugguuucucuguauaugaacugaauuacuaauaaguuuaguuuaaaacugacucaguaccugaaaaucuguucaaucaugaaaauuuaacuugauuaagaaaggcaggguccuagaaauuauaaaauacccucauucguaauuuuguaaucacaauuuauuuuauuaacaaggcccaaaugaggcacagauauucacacugaaugaaguguaacaccgaauccacgucuuuuauuccuagaaaagaagacuuuucagucuacuuauuuaaccuggucagaacugugucaucgucuugcuucacgccccacauaguagcagcaaaguaaaaaagcuaaggaggcaacagaaugucauggcagucagaugugauagcuuuaaaaggauaugaaaagcaagacagacccuaaaaaaugauggaaguagucuaaaagccacaauaauguaugcuuugguguaaacuauuuaguguaagaauaaaugguuuuaauuacaaacaaaaauauguuuuuuguuuaggaaggcagacaaaaauuugcaggcuuuuugucuuuuuaguuuuggauagaaaaucuuucuaaagauugcugcuuaaauggguuaacucagcuauaucaacuagaagucuuaaaaaaaguaccugaaaacuauauacauaccccaaguucaucuaaaaacaugaucauacgauguuuguugcuuuugaugaauggauugacaccuuccauguagggcuccugaaaaauaaaaugcuucuguuauaugcaccagaaacaaaccacuguuugaucuauuagguuggugcaaaaguaauuacaguuaacagcaaaaacugcaauuacuauugcaccaaauuaauauagcaaaacccauacauguagcaauacuucuuauaaauuagguguagcagcagcaacacauucacaagaauuaauuaaaucauauaaugacaguauuuuccuucuaguauauaagcaaauggcuauacugaggaguauggguauuuuuaaugaaagaaaauucuggacccaagcacaaaucguaacacauagccuggcagacacaaauuguuuauauauaaauucacucaaacauggccccaaaucauagguuugaauccagcagagauuacagggaauuaaaauacaauauaauaaagacugcaauaggaaaauaucuuauuuguaaccugccucaaagauucagaugaauucaaaaccuaggccauacacguaguuaacugcucaucguacuaaaauccugacuacuuaaaaccaugcuauaaauagggaaaauguuaagauuaacacacucuuuuaaaaucaguaagaaacucaaugagauaaggaccucaauaggcaauuccaaagauaaagacaugaaagucucucuaacaguaauaaaauaaugaaacacaaaauauuaugccuauccaauuggcaaaaaagaaaaaaguauaguacccaaugaguucuggcaaggcugugaggagcaauaaaaguaucuuaaauugcugacaggaaaucuuguaacacauagcaaaagccuaaaacguauuuacuuagugauuuuacuccaaaguucagcuaauaauugaguaaguaugaaaggaaauguaugcaagaauauauguuacaacaauaacagggacaaauggaagccaucuaaauauccauuauuaagaauagugaaagaguuaucuauuuccacauauggcaagaagucugucacguauuaggugacaaaagcaggaggcaugauaugaucccaacugaauaucagucauuauccuuagauaguacaauuaaguguagguguuuaaaaaaauaaaaucuugaguuuuaacauuuacagugaauguuugugaaauaaauuuuuaaaugacuuuuuguauuaaaauguacucauugauuauguuuaaaagugggagaauuugaguacacuggaccuugaaaaauucguuuucuauaauggcuaaauuuguguuuuuuaaaguuccacuauuaaaauguaaaauuuaaacaagcuacuuuaaaaacaaacauaccaacaaaaauaaucuuucaucgcuaaaaauuucacugcuaaaaauuuacuuaagccacaauuuaugguuuuaucaugucaaacuugcauucauaaauuacauuuuaaaguaucaaaauguuuuuaccuuagcuccaaauuccacaagauuugcuaaguucugcacagauuuagccacuaauaucaguguucuugcagcaauaggagauggagaaucuguaacagaauugggcacagcuaaugacaccaaguccaacagcacuuccagcuaaaccauuauaaauuuagcacuuuaauauuucuuuacuguuaaacuacuacccauucuuccauucggaacucagaauguuuuuggaaaaauguuuuuugaaaaauuuaugauccauaaaauucaaaagaacuugaauuaaaagagaaaaagugaauaugcuuaucagugcuucuaggcuugcgaaaaggguacuacaaaacucagcaguuuccaacgguugauacuauuucaaaggaccucaaagcuuuaccuuuaucacuaaaaaagauugucacuccucacaucuuuuaugacaguucacaaagcuaauuucaaccuacucagguuagcaaucugagcaauucccugcucccaacauuauuugcaguccaaauaauucgcuuaaagcucaagaagcaagauaaagucuaggaccucugcuuuauuuugaggagaaaaacaugaaauuuaauaaacuuuuaaaauauuuuaaagguaagucaggaagcacuucccuguggaacacagauaguaggauguaaaugaaaaguauuggugucuauuaaauauaagcucuggaacuuaauuauuuaacaguaaaaucccauaaauaaucuaccugacugccuaguuuuagaugguguugucugaggcgaacauccagauaaaucucuccaaaagaauuucaaacccuuaauauuaauaauuuauagauuuaaccacuuuaguagcaauaaaagauaauuacagagaugugauggcuauauagaaguaaaaauuaagacauuccaaaacauuuuuaguacaauuuugagcuucagauuauuaagguaaaaaugguuccaguuccuacuguuuauaaugguucauuauuacauucaaagucacaaauaucccuguuauccuuucuuugaaagaagcuuuuaacaccugaaagucaucucaaaauggauauauggguaauaaaacuggaucagguuuacugaaguuuaaaauggccaauuuacacuauauaacuggugacuuuaaaaaucucuaacgggaggaaccaggacugcuuucuucauaaguacucacagaauacuauuccaacuguacauaucauuuaauuugaucuugaagaucuagcuggcagcagucuagcaaugggcuaagcaaagcucuucccaacuugaaaaagccaagcugcagacuacaagaagucacuuauuauaaagguuugagacacaaauagggguagaaaaaagguggaauguguguaaucaugccaucucagaccagauaugagauggaagaaaagaaacaaaaagaaaaaagcccaagaagcacaagcacaaggaaggaagggugcuuuggaauacuucauauaugccaugacuagaauuggaugaucaaaaaaaaaaaaaagauuuaagaguauucuuaaauaguaugaaacuguuaauucuaauauuuugaauuucaaaauguaucaaaagcugauuaccugagaugauauugaacauccguggauucaggauggcaggacagaugagucgaagaaaaacaaaaccacugaaugggagggaaauuuuuuuuuuuuuuuuuuagaaaacaccuauauaauguguuacauuaaaacaauauauauaaacagaauuuuuaguacucauagaacccauaaaauucacucuaaaccaauaaaagaaagcccagacacagaaagcuuuaagaaaacaguaagccaaagcaucguauuuuaagaauauauauaucugcuucuugaauguauuacucacuuuucccaauuuagaauguggauuaacuuugggaaaauguuguuuaucuguaguauuuacugucuugcuuacuauuuauuauuccaggcuaguggucauuugauacuuagagaaaguaguauccucaggaaucuuaagaauuucugaaauaccacaggaguagaaauaaacuuuuuauauaagcauaguucuguacaauuuuagaacuucacacacccucauuucuuaauuuauuuaaacagaacagccuaaguugguugcauugauuuuguugaugauucacauaaaaauaagaauccauugcacuagagaaaaagugacuuauugaucaaugaaaaugucuauaauagaacacuggaaagguuuucuuuuuuccuuuuuucuuuguuuucuuugagauaggguuuuguucugucacccaggcuggagugcaguggcccacaaucacagcucacugcaaccuugaaccccugggaucaaacaauucucuugccucaggcuuagaguaguuaggacuacaggugcacaucaccauaccuggcaauuuuuuuuuuuuuuuaauuauuuuuguagaaagcagagucucgcuacggugcccaggacaauuucaaauuccuggccucaagcaauccuccugucuuggucuaaacauguugagauuacaggcuugagccaccaugcccagccugaaaaacuuuuaagacaagacauuaggaauucuaaaguuuuaaaaaguugucaaauuauaaaacaauagcaaaagcaaaaauuauacuaacagcugucauauaugauuuuaucugcuaauuuuacuuugggacaaugucaguguuaaaagcuugcauagauacuccuauucugccuccuuuagucacugguagggaggauauguugucauguagauaauuucuaauuuccuuuuaagaagaauccacacuaauaauuaaccucuuacuugccccauguaaagacaagcauuauuccuaaaauaaugaauuaugcaauuccuucuacagauugauagacauaauccauguaaagacaagcauuauucccaaaauaaugaguuacgcaauuccuucuauagauuaauagauacaaucucuguucucuguuagaguggauuacccaauuucuuagcauuuaccuuugaacauguaccuguuugcuaauuuuuggacucuuagaaaguaaagauguuacuucucaaacagcauuuauagaaauucuaauauauuggcugggcaugguggcucaugccuguaauccaacacuuugggaggccgagguggguguaccaccugaggccaggaguucaagaccagccuggccaacauggucuaaccccaucucuacuaaaaauacaaaaauagccagguaugguggugcaugccuguaauccagcuacuuggguggaugaagcacaagaaucucacuugaaccugggaggcggggguugcaguaagccgaaaucacaccacugcacuccagcaugggcaacagagcaagacccugucucaaaaaaauaacaauuaagucuuuaauuuuggacuucccaaauuuaaagaaucuuguaaacuuuacuugaaaauauugugauaauuauacauaguaggucuaugagccugaaaccuaaccuuggcaaaaaugcccuaaaacacccucuugcacgaaacaguuuacaauuuccugcuguguuugcuuaacaguuauacuuguuugaaacuuacaaauuuauagaacaguuuuaauuuacaucucacacguaacugugcuggaauauuaugcuuguaauucuuuucuauuccucccaaucaccacuaaugccaagaaaaacagaaucuguaguucuuaaauauuaugucauaucauaaccaagagaaauauuaccugccccccaaaaaaagaaauagaagccccuugacaaaauuuagguuggaggcaggauuaacacauuuucaaaacaaacuguguaauaaugguguuaaugguugccuaauuauuuuacauauagcaugacaugacaguguauauucuaaauaacaaauuauauuauuagaaaacugcuguauuccaugacgcuuucgcauuaaacuuccauuugccuggaauuaguugggguauuaguuggaguaugcuuaacaaaagcaaaagccuacaauaagacucaaggauaucagauugggucuuagaaaguuaccuuuaguucugccuuagccaccagcuuucuauaaaaccuuaguucaacuuaaccucuccagacagaucugcuucuucauuggaaaaauaaguuagaauaaugauaaugaaguaaccuuacguaagcucccaaauuccaugauuugccaaagcaguucuuccuauagaauaaugauaaugaagucccuuuauauaagcucccaaauuccaugauuugccaaagcaguucuuccuaauuaugguacaaugagcagacugaaacacagcuucagaacuacauguucugguucugauuagcucagagucacagauuguaacaaaccaauuaauaucuaaaucggucaauuacugcccuucucucucacugccaaucaauguguguguauguaugaagaauacuauaugaaguuagcuacagauuuuguuauauaacuuuuagccucaucuuguaaggguuuaaaaauccccaauacuugacuauaaaugaauguucauguuuuuagaaaaugcaaacggcagcuaaaucucacaguaacuuucaguuuaggagccaucuggacuuagaaaauaugcaacagggcuuugacauaaaagccaaagaaaaaagcauugaauuguauauuguuauuccucaauuuuucacaauuauccaccuauuaguaugugauuuaacaaaucaauugaugagccuuaccuaacaacucuuguucucauggugguauuuguaggccacuuaugcugaacagauuucuguaaacacccauaaauauaucucaauguccugccaaaauaacacaaucaucucaacacagaaagcaagugaaaacacugaucuccuagcagccaaaagcuuaauuuacccaaauauaccacaguucaauaaaacuggccuuuuacccaaaaaaguauuuugccacagguaaugaggcauuuagcaagggguaaggaaaacuuuauccacuaaguuuaucaucaauuuauucagucaacuuccugacauuuacuuucagauauagagaaccaaccagcugcaaauucuggggagcaagauuuagacuuaaguuaacuucuaccugaacaagugaguucacuaauacuggaggccgacaagcauauuaacagagugauuagucuaucaaguauagacuaaauggauagacaagauaucuuuuacaaucucaaaucugaaacuauaaaccucuauucacuccccaagcuacuacaguacaaaccagacauauuggcuuguacgaaaauaaugggugguuuuauuaagacagcuauuuucuuuaaauacaauucaucucauaaagauuaaccaugacuuuuucagaguauaauaauauuaggacaacagaaaagcuuucacguuuuagaaauagaaauuucugaagacauagauacacaauuucuugucaaaugaaaauuucaccacuuacgguggaaguauuucugaagccaugaauauuuucuccacaagcucugaaaguauguucaauagguguguuaaauuaguguucacaucuucauuuuuuucuaacuuugauggacuuaacuaaaagaaggaauaaaucaauauaaaugcauguuggcaaugacaaaugcaaaugaauagaggaaaacaaguaguuauaguuuucgagguugucuauuuuucgguaucucuguguguauugaucuuuuuucuuuguauaaugggaguuuuuaaguaguuuucucuauggaacuccuccugguaggucuguuaccauuuauucccaauuagccaacugaaaagcaaacagugcuuagucaauucuauuuauuugaggggaaaaaaagcugauuaaaagcuuuucugaaugaggcuuauuuaauggcuaauaaaaauaucaaaugccuuaggcagaaucacaaaccuuucucagaacuuuuccuguaacccuucugaucuagugucagcagaguacauuuaucuauggaagucggaauuccguagccuaucucuaaaguccagagacucccuaccuaccugcugcacuucugugucauccuuauguuaggccaacuauggcauuaccccacauuuccaacauuaaaucacuaauuucuucccuucaaguuauuaguaugaaucgacaccuucgugcaggauuaacauuugcuaggucccaguguccauugucaaaaacaauuccuuaaacugauuuuuauaucagaucuaauauauauuauuucuuuguaguugcuuuaccauuaaaaugagagaauaugugugugagauuccacuuacugucuuaauaguguauuaugaauuuauacugaaacuuuaauaauccuaaaaagauuuuuuuguuuuaguugagguuaucucauaauucuccccucgcaaaaaaaccuucaagaacaaaccaagauguaaugaagugcuacauagguuauauaaugagucacuaacaaaaccuucaauuuaucuuaugcacgcuuucuguaaguaguauauagauuauuaguacaguagaggaaaugacaaaguauuuucaugaauuucuggugcaacuugaugguuuuuaaucccaaaauaaaguacaucuuuuuuaagaaguccauuuugcagaacauuuuuauaaauguauuacagacagguguaacugcuaugaggaauaauuuuagaaauuuaauauauuuuccuuaaaauguaauuggcuacaaauuauuaccuauuaaaauauguucuuugcaaaaauacuuauuaaaacauuaaauucuuaccucacaagacugcuugcuuuccauuaucuuuaaaauagagucuuucaaagcaugaugaacaaacuguguagcaguggcuuucauauacugcuccaucaaggugcuugcaaguguuguggcucgaaauaggguaguggcuucaucuacacaaauauuuacauuagaagauuauuuguaaaggacugaccuaaugugaccaaauuggaaauuaagugaauucauuuuaccucaacaggaauagccacuuaaaugugcuuuuugcgugcagcguugaaaguacuaauuacaaugacauccuauacuucuacagacuuaacucuguaagacuuucauauguauuaccucauuagaucaugaacagaagggauuaacacugccauguucauauggaaaaaugaagacucagaauuguuauaugacuuaagaucaauuagacagcuaaugauaaaauuaggaccauaaaucagcuuugcugcccauugaccccaugcuuugaaauuuuaggguuuauuuacaauuaaggauauaacacaaaaucccaguauagauuaauuuauuagcuuaaaauaugucuacugaguuucaguaaaauuuuaaugaaauacaaaugcugucagaaaagauaaacucaaguguaaaauaaggaccaccauuuuaucuauuccuugacaaaucuauauuuugugaugaggaggaaaauaguucuaaacuuuacuauuuauuuggggaaccuagaagcaagaacuguuaaugaaucaaagugcuugguggugugugugggccagggggaggguggauuauuuuguaagccauuaaaagcacuguguccagcagcuugggaacuaccuaucuauaaaaguuagaaauaaaaugcagcugacacccagcuucuguguaaugaagaaguaaaaauuaaacaagaccuguaaccccggcacuuugggaggcuugaggcaggcggaucaccugaagucaggaguucaagaccagccuggccaacauggugaaaacccgucucuacuaaaaaaauaaaauaaaaaauuagcugggugugguggcauaugccuguagucccagcuacuuaggaggcugaggcaggagaaucgcuugaaccugagagguagagguugcagugagccgagacugcgccacugcacugcagccugggcgacugagaugccaucucaaaagaaaauaaaaaacaagagaauacagauaaauaugccaaacagucaagccauugauguagacacagauaccaccuucuuguggcuucuaguacuuaucugccaaaaccuacauuagaaauaucagcuucccauaguaaccaacauaaucagaacugacauccaacugcaauuuuuaaggagggaaaacagaauaacuuauuuugcaauauaauuuaacaauuuaguauauucagagauagaguccauauauccuugauauaaaaucuaaacccaguuucuuguaucacacuaacauggccauaccauaccuuccaugcuuauuucucugucauuuagugugcauaacaacaacgauucaagcuuuucgugaagaaaaauccucaguaggaugcuggccaguaguguucggucuuguccacauacaugugauaaagcauagacuacaugaaguuccuuuugcaguauaagcuaaaaugacauuuuaaaagauuguuuaaaguacguagcauuauaagcaugcuccaugagacuaacaagaaauauguucuuucacaaguucuuauauuuaaaaugaugucccauugaauaaauuuauuuaaaauagaaugaauucguagucuacuuauuucuaccaaaauuacaguauaaaacaagguuuaaaaucucuggcaucauugugcuacuaagcuaugaauuacuauguuuaccuuaauggaucuuuuauuaaauguuaaauguuucuguuaauuccaacaaaaacaagacugauaaauaauuuaauaccucuuuaaauucacuguacucuucuucuggcaugauuuuuuccauagaguaucgugcucgaacacgcagggacccugguucaauaccuuuuaaugguauaugggagcugagcagaaaccauucaucuguggcaugcccuuucuguaaucggcucaacuggcagcgcauaaauacuugggaagaaaaacaagcaauuauuguuuaaaaagagaacacgauaauuagucaugcaaguaaauuuuccugguguucagucuucccuaugguguuaaaugcuuuucauuaaaggaguuuucaguaacaucacaaauucaauauuuaguuguuuauuuacugagugucuacggugcacuaaacucugauagguagagaguacagagaugauugagauguguucuuugaguugcauagaggucaguuuagucaagaaggcaagaaaucaauuauguuucagcacugguaagugcuguuaacaguggugaaugcuauucgaguacagagaaauaauaucuaauucagccuguggaggugaaaacuccacuuuaaacagguaacccuugagcggacgagaucuagagguguagcuaagaagaaaaguagugaaaaaagaaaaaagagcacuucaaauauaagguauggccuucguucugugucauuacuaugggguuuggauuuuaucguaaaaguaauggaaaacuaaaauuacuacaaaaaacuacagaauaaacauuuuauagagaaauauucaggcuuugaucuguuaauacauaucacuuccuucccuaagccugaguuuuaagaagguauuaaccuaauucacccugaugugaacugguaaaucucacugucaacuguuuuagcagcaggauggaaggagcugugcugcugaggacaggaacugggagccuuugacuaccagaagugaauaagugacauauucaaguuuaagggaaauuuuuaaauagaauaaaugacauucaaguuuaagggaaauuuuuaaauagaauacuuuuuuacuuauaugguaauguaaucccagcauuuugggaggccgaggccggcagaucaccugaggucaggaguuugaaaccagccuggccaacaugcugaaaccccgucucuacuaaaaauacaaaacuuagccagguaugguggcgggcgccuguagucccagauacucaggaggcugaggcaggagaauugcuugaaccugggaggcggagguugcagugagccgagaucacaccacugcacugcagccugagcaacaagagcaagacuccaucucaaaagaaaaaaaaaagcaggaaaaaccuaaaaaguagaaagaagggaugagggcaagcccuacaaaaagaccacuguaaucauuuccuuauucuuccuauucauuggagaaaggaggguggcuaaauauuuuaaucuuaauugcuuaacaguguguacaguugaaccauauuggucuuuuucuaucuuagguauauucuuucuugauaaucaauacuuuaagaaguacagaaagaaacuaucucaaauuauacuacuugcauuucuguuuuuuuaauuucuauuuuaagacuuucauugugaauuuugaaaguauauaaaacaugcuuuuucuauuuuagaaaguuucuguaucaacuuacagauaucaggaucuuugcuuuucuuuguuuuauuacuaagaguuauuucaaaucuauugaugucaggaggaagaucacuaaaggagcaaggagaaaaagaauuaacaaaauguuuuggcaucaaacuaccuuauuucuuuaguucuaguaucaaauaaacccccuauuucugcuuuaaaaaaaaaaacagugugcuagaccuaaaaccagauucacaacauauuuuauuauuugguauacagaagacacgcagauuacacacuuuuccuaccaucuuuaaccuccuaaacuaauaauucauucaaauaaguacuggaaacccuaguaaauguuuuguauuuguggguuaguaaauguuuuuugacuugcuaauucauguuaauaacuaaguggaaaaaccaagggcauagcacuucacaaauaaaggugaacaaacaacagaaaaaaaaaaaaaaaauauauauauauauauaugcuauuagaacaccuggauaugguaccuuguucugaugguuuagauacagagaccaaaaaaacagaaagaaaugcaauaugguaaaagaaaaugauuaauguaaugauaaaauaagacuuacucaaagacaaacucuucugaccauacuggguuuugcccuucccuugcaugaguuuuugcuacuuggacacuauucagguagauguuacaauauggauuaguaaaauguuuuacugggaguuuaugggcuucuucaauauguaaaacaaggcugcugaccuaaaaaaaaaaaaauauauauauauauauuaccccagauuucuagaauugcacuacauuucaaaagcaauuacucuaagauacaaagccaaaaauaaugacuuauuuuccccuuuuuuuucagaaaaugugagcuuugguuauauauuuguauaugacauacuuaaaacauucagacauuuaaaauaauucuucccaccuaaaagauaaaaacaaugcaauuuuauuuuacaaguuauuucucccaguauauuccuggagaaauaaugaaauacaccuuuucuaccauaaaacaaugauaaagagaaaaugaaguuaagaagaaaauucuuuauuaauauaaguaaacaacugucacuacucaaauuaaaaucccguauguuauauaauacuuaucuggaagauucuauuucuauaaaagaguuccacagcuaaaaauuuuuaaaacacugacuuuaccuucuuauuuuacaggaaaggauacaaaccuaaagaaacuaaguuauuuguuaguuuggaugccaaaacuuagaccauccaccuucuaguaucagguucucuuucucucuugccauauacuacuuguguggccuugcacaaauccgucccucuaagccucaucuuucuaauauguaaguauaaagucuacacuacagguuguaauaaguauuacaaacuaguuaucccucaguaucugugggggacugauuccaagacccuccaccucucuguccuggcagcuaacgaagcccaagaugcucaagucccguauagaaaaugacauaguaucugcauaaaaucuaugcaugccccccuguaugccguaaaucaucucuagauuacuuguaauaccuaauacaaugugaaugcuauguacauaguuguuauacuguaucuuuuuauuguauuuuuucgacccaugguugguagaguccacugaugcagaacccaugaauagaaagggcugacaguauauguaaaucacuaaaucacacugcccacugauacauaaaaagugcuugagagauguuagcuaugauuauauuaaaccugcaaaugucauuuuaauggcucaaguuucacacaaaauacaacuugcucuuauuagcaaaaauccaaucugauuuuugauagcuuacaaaauguuacaauguuaugaagacauggcgauuguguguauacuuaaauuucccuggggaagagccagacuuuggguuacagggacuauuuagucaccuaaauaucaaccauuauccacucccaguagaacaguauguuaaucacucagcuuaucagauauucgcacaaagagaacaggagacacuuugguuaguaaauaaauauuguacuaaacuuucuuuaaaccuugagaaugucaaaauuugccuaacuucuuccaauuauacagggauuacuaaaaagaaaaaagccaagaaauggagguuauaaaguuacccuuguaaaggcaaaaaaaagagaaagccuagcuuaacucuccacaaaucucaaaguauagggcauguuacaguuucaaauaagauuaaauauuuccuaagaguuaagcaguagguuuuaaaagcuguucuucaaaaugaaaaucccaaaaaaguuuauugggauuagugcuauaaaucugaugaucuuuucaauguucuacuuuuuugaaagaggccaaaauaaguuuuugaaggaaaauuaagugcccaacagaaccguuucugcuguguugguuuaguguuguuauuuaaaguggaagaauaaucuuucuuauguuuuuaacaguuggcauggacuaagaaagaacauucucuuucauaaagaaguaacguuuuccugcuacugaagcaaguggcagcauggcuuaaccccauaugauguccaaaacaguucagauaaaaauaaaauaaaaagagcaaaguguuagagcaaaaugugacaauuaaaaauccaagaaaauuaagcuucaccugacgaaggcguuuauuggaugucccuggacuacuuuuccguaaauugcaaaaugccugcagaccuuucauccaauccugcaaagaaaaacagcacuucaaagaaauauacacuaguuuauuuggcuuccaaaucaucaguuagguuuuuuuuuucaaauucaacaauuuuuuccuucucuagacugccauuucuauucucagacuauacuguacuucauaacaauaaccaauaauaaaauaacaauaacauaacaauaacaauaauaaaacaaccaaaacaauuguaauucuguauaaaucuuuguuugaauuuauguaugaaacacaucgaguggccauuaauuagccaaaaaaucaaauuuacauuaaagaaacuauuucucccaaacagauacuaccuuggggaaauuaacuguauaauuaagcuguuauacuugaggcaagcuuagguggaauuuaacuugauacacuuugugagagggggagagugcugauuguaaaaccaacugauaaugugaugaccgaucccaugacaagcauauuaaucuauacuuuagaccaugauacagguagaaauguauaaggggauuuggguuauuuuuaagcuucucaaauauaacauuagauuuuaaaaaucauuuuagccuaauauucaaaucaaauugcagccauauuuuuaaaauguuuaucuagugcuuuggggaaaaggagagaacuaagguuuauuaaaaacaaaucuaaauauucacuuugguuuuuacauauuucuggaaagcuguguacuauugcuuuauucaauuaugucuuuaguuuguuggcuauuucaaugaagcugaacuuuauuaauaucuagagacugucuuuauauuacagcaaauuaaaaccaaaucaguuaccauagcuuuuugaaauagaagagaauaaccagagacccccacagcccaauaaaucaacaaaaacuggaaauaccauuuauggaaauacagaaauauuauguauaaauacauuaaaaaauguucuauguuaggcuugcaaaacaugcugaaaugucauuaugguaugugacauuuuauucagaaagagggaccaugguaaaauacuuagaaaauaggauacugaaguuuaaauuucuaacucaauuucuaacauuuaaaaaaaucauguaaguuaccaaaauguuuugagcacuaccuuucucaucuaaaaauuagggauacauagccguaaaauuuuaugugcauuacaugugaaaugagcauuaaaugagauauuugauaaagaugugaaauaugacguucaguuguaagcucauucagguuuauucugugagucucacgcuaggaucuaguuuuaagagcaucuuccucauaucuaggguuggcaaauuauauuuccaacaaagccacuuucacuucuuaaccaccuuuaaguuccuucguuagaauauaagcagaaauuuagcuguauuuguauaaaauacaaccauauacuccagaaauauuaggguucaaagaaagcaaaaaaauuuuuuaagagacagugucucaguuuguugccuaggcuggcuuacagugucucgaucuuacucacuguaacucaaacuccugugcuaaugcaaucuuccugccucauucuacccaguggcugggacuacaggcauaagccagaacaccuagcuaauuuuuuacuuuuguuauagagguggguucucccuuuguugcaaaauauuuuuuaaagaguguuuuuuaaaaaauauuauuucuucacacaauuacuuaauagacgcuauaagaaggacacugcacauggauuaauagcuaaucuaaaguagacauuauaucucgacuuggcuuagagaauagauuccuaaaauaucuuuccuuguguugacugacuuuuauuuucagacauggaguucaaccagugaagaauaaugcuuguuagcaaaacuaacugguuaacuggcuuaccuuuggauuauacugagaugaccuauaaccuuuaugcagagaggauuuuaaaugagcauucucaguuggccucaacaucauagaguauuuaaaggucaauuuaaaauggaguuuucauuccuaauaacccuucacuguguuuguuuuugcauuucuuucagaaaacuuuuuacauaugaaaucucauuccuuaaaauaagagaugauuagauuucaggcguucugucacuuuaucuugaaugcgaucauuuucuauuccaguuaauaagaaaacaugggcuaacauaaaaguauacuguaguuugagaaacaguaaucuuaccucugcuuguucuggaguuucuccugcaaaguaaaagauguaauguucuucacuaaagugcugaacuacuaucugaaaacaguuuggccuuuaaaauaaaaacaaaaauuauuaggaagcuuaauaaaaaguagcaaaauauuuauaccagcuuccaaaacacucacaauaaauaauuaacauaaaauuauaauucuuaaagaaauaauacuccauuguaccagaucauuacuaaaaaaaagucagcuauauauauuuuagaaaacuuuaugucagcacuauuaaaauguuaucaguauuucaaaguguaaacuaaagaaauuucaauuaauuguaaaauacauuagaaauaaaguuacaaacagauugaagcugaacugcuagaacugcacacagcuaauuugaaaagcuuuauaugcacuggaaaaagacuagaaauguucuuagaccaaaaauguucuaaguaauuaucucuaaggagauuguaggugauucuguauuuucaaauuuuucuaaacugaucauuuuucuucaccuguuaaaauggaaacaucaucucuucauacauaugcuuguucuagaguuuaagugaacaguuguguacaacaaauguucuugucuuccuuuaguauuauuucaaaucauuugauauguaaguacaauauuagguaauaauuuauaucauuuuggaaaugugcuaucuuuccaacuagacuugaaaauauugguaaaaucuuuauuaagggccugcauguuuuuggaacucaauaaauguuacuucuguuuccugcuuuaaagauuuuauaucaugcuaauguuaggaggccauagcaaaaauacacagaggacaagcuuaacacuuauuaaagauaaagacuauauuuucaugcuuugagaaugucuuaaaaguaaucauggaaaauaggaauuggaaacuucuaauccuaaauguugccuguaucagacuaaccacccuaguuggauaaaacuuaaaauaguaauacaaaacagaaaaacaacuguuugaaagcacuggagaacaaccaaagcagcuaagauuugaggagccaagaucauacuauaauuaacccgacauucuccacaucuuuuccguucaaggcaguugccaguuccuaagcuggcuguguagcugagacgcuaagcagaaaauaguuccuaaaaggcuaaaaaauuaacuacaaauccaguaguuugauagugcuaggagaaaaaagaaugaauuucaggcuuuccauugagaccccugaagggcugugccuucaugauaagggcaaaccagaaauagaacagccuuuacaagauguacuaacccuauaccauccguaagaacaauucuuucuggacgcaauaacauuaguuuccauaguuuuucauguacaaugucuaccacuuagucaaacuaaguagacacuacaggcaucaggauuaaauggcuaaaaguuaagaugaaaaaccagaaagacauacauauaaugcagauacugaagacagacaagacuuucaaguaauuauaauuaaaauguuuaagaaaauagguaacaagaauuuugccagaaacuguaucuuuaaaaaaauggaaauucuaaauugaaaaaaauguaauaaaaugaaguccugaaaaaguggauuuaacugcagaauggaagauuagugaacugaaagaucagaagaaaauauauagguugguacagaggaaaaaggaugaaaaacagaaaacagcaugggaaauagugcaacuuuuuuuuuaaccagacuccaagaagaaaaaggaauguggcagaacaacuguuuaaauuagauacuaaacauuuaaacagauacuaaccaagaguuuucuaaaacugacaaagaacaucaggucucagauugaugaagcacuacaaaccuaaggauaauuuuuuuuuuaauuuauaguugguacauuuuaguuuucccacuaaaaauauaaggaaaaaucucaaagcauccagagaaaguugugugagauacauuaccucuaagagaaaagacaaagauacauuaccucuaaaacagaaacaauuugaaugacaacgaaaauguuggaaggcagaaaaccaucuuuaaaauggcaaaauaacugccaaucuugaauuuaauauccagcaaaacauuuucauaaauaaauguaaagcaauaaauaccacagugagauccagcuaugaaaagaugguguaaaaauuaauuaccacauggauagucacuagaauaacuuugugucacuaagacaucuuucuaaguaaugcaguauuaaaaguuagaaguuuaauacaaggaaauggagugcuuagagaucucuuaauauugaaaauaaucuggaaaaauugcacagcugugcaacuaaagccaugcaagaaaacagcauugccauccaacauucguucagcaucaggcugagcaugcgcacuaaucaccuacugcacaagguggcuguuaacuuucacauuagucuucuucuaaaugcuaaaggucagcauaucagguucuauguguacacaaagcaggaaauguucaaugccuggcauuaauuugauaauaaagaaaaagauauuaacauucauuuauaauuuccccuuuuguccucugguauuugcauccuaugguaauacauaauuuaucaaccuauuuuucuacuuguccuauuauaugguacagaugucuucucauuuccuugaaauguacuuuguuaaugcuauuugccuuggcauucagucuuucucacuaagugcuucucuauuucacaggaaggcacuuuaaaaaaaauaguuaauaauaaaguagcauacuuugaaaaaaaaauuuuuguuguuguuuuugguuuaguuuuguuugagaccgggccucacucugccauggguguagugguacagucagcucacugcaacauccuggcaguugugagccugggcucagacaauccucauaccucacucuccugaguagguaggaccacaggugugcaucaccacaccuggcuaauuuuuuaauuuuuuaaagagacgggguuugccauguaggcccaggcuggucuccaaccccugagcuuaagcgaucagcccaccuugggcucccgaagugcugggauuacaggcgugagccacugcgcccagucuuaaaagaaaaaucuguuuucuaaaugagagacuugaguuuaguucucaugaacauaacuuuuucauacuagguuucagaccugguaucauuaaauauaauucauuacaaagacuuuuucuaaugucuucaaauucuuuaagucaccuucaacaagaaacuguacaagaagcaagcuacaaccuuacagcaagugguaaauguauauuuauugcuuucccccuaccagacagaaacuccuuucuuguuacuaaccagaauaggaaucauucacaaucuucaacuugugcuucaaggaucugauccuucuuuuuacucuggcaauucuuucucuuuuaccaucaaguguaauguggaccuuucuuuugauugugccaacagacuuccaaucuaacugcaucuguucauauaaacuauaucaaaauaaugcuaaagcuuuucuucaaucuuacagauauugcaauauucaucuuaauacuuccuuaagauucaucuaauugcaguuguaaguaucauuagugaaucauuuuuaaccucauuuuuccaagguugaauuucugccuuaaauccauaaacugucaagacacauaucuuuuuguauuguacauauaauuugacgaaguuuacugauucuucaguaaaucugcaaaaugagaaucauucaccaaaaguuuuucuccuauaaucauaaacuuuuaucaaaacuuuucuuuuggacagguaacauacuucagcauccaacaguagguauuuugauuccauuucucaccuaaaacugaaaacacaugcaacugaagcagcuuagauuuuauuacagccuccauuucauuauauuauuuaauauggaauucaggucuacagacaaacauauauauaaucuugacauaaaaucuuuaaauguuccuaucgugaagccucaucaucagucauaaacuuaacuagcauuuccauaggaccuucuuuguuucaaaguauuaaaaaaaaauuuagcaauuaaauguauuucuuucagguccuaguaagugaguuacauuuuuuuaaaauuauuuuuuaucuuaugagucuaaugacuuuccaguguuagucacuaaauugcccuuauggugggaaaaauuaacaucuguacauuaaggcuaauuauaaaguaguaaaaaugaaaaauauaucaaauucauuauguucuuuucaagaaccuccuuauauauuuuacgauaauuaaaacaauuuuaacuucucuguuaaucgaaaaaagguaagaaacaaaaugagacauuucugcuugaacauaaaagguagcuucauaaugaagcugugaauaaaguaauauucagaguaccuggaugauugaacaagaaaguaggaaguacugagguauagccacuauaaagagcucucugucuccaaguguuaugcaucaauucuuuugccccaauaaaauaaugaauuagaacaguuuauacagggaucauaugauuucgaguguuauaauuuuugaaauauaaaacauuuguuaaauaucucuacuacaauaggauuuuacaaccacuaguaucucaggggacaccuauacugauuaauggaacacugguuaggaagcucugcucaacuauccaacugaauucauacccauccuccaagaaucaagagccaccuauuucauauuacugaucucaauaaaauuguucccaaaauauucuacuuuuacuguuuuuaacuguuuucacgauaauaaacuacauuuaguagugaauaguguugccucuccaacauccauuucacccauacauaugguaaguagagcagccucacuauuugggugagaucauuuccagcaacagaucuaggcacaaaagggucuccucauucuaucaggauaaucccauuccuuuugcuaccucaguaacccagaacuaaaaauugguugagagguggcucaacagaauguuuucaagauuuuuuaauaauuaugggagugaaugcuuacagcccuuucucuggugcuguuugcuaccuugcuaccauguagggaacugguuugaggaaggauucaacccacaagaagggugcagaguagaacuaaaaagaaaagacagaggccugaaucaaccacauuugaagguuaagauucucagguuguuaaagaggggcagaaaaaucucaagaaauccuguccucacgcaaucuuuguguuuuuuggaacaacucuuuaugagguaucagugaguauucaggggaaaaaaaaggguaucuucguaaaaugaauuuaugaaguaauucauacuauuuuacagauucacaauauaaacacuagcuaaagcuacaaaaagccuugcuauaaguaaaacuauuuguucaaucagcauuucccaaaccuauuugaucauuuuaaaaaacugucaaaaucacaaguaacacuaaugugaucuccuaaacacacugaaaaaagaaaugacaaggcuauauauuuuacagguauuucucuuaaagaagagaaauauuucaacaggauaaaacguagauuugccucacagaaaugccauccugcggcagaaaaacaagcuguugaaacauuuaacugucuuuucucuuacuaaucauaacaauagguaauaaaaaugguaaguacaucuaaaaagacugggauggauuacugauaauacuaauggugaaagguaaaggccauuguucuugagaaaaaaaucuagauguaaucaagagcuggauuugucuucugauguuuaggauucagcuuauacauuuauauucauuguuucaaaaccaagaagucaacauaagaauuuuuuuuaauuucaaauacauuuuuccuaucaagacaauuuuaagauuauuuuuuaacauuaacuuucuuaagaacuugcuuauagaguuaauagcagaauugagugcaccuaguacucuuggguacacugaguuaaaccaugugaaaaaaucagaggaaaggugacaaagacucaaaguaagucacucaaaagauugcuuguuggggcagggacaaaacaugcuuuacuacaggaaaugucaugccaaagauuucugugcaacacaaugaaguagacuuuauguauauauuagucuacaauuaagcaaggaaggcaaaaauuaccuagaaagugcaucugcuacuuuuagaagaugauuuuagggcucucaaaauugguuugcuuuguuuguacuauuuuauuauuaagacaauuccgaaagaaaaauaggaaaccagucucuuaccugccaaagagacuaucaugaacgacauagacagaacauacacugagaucuauuaauccuuuugguuugguagcucguuuuucgcuuucaaaauaaauaaguugggcaucacuacccucuaagauaaaauauaaauuuuuccaacguuuuccuuugccuguuuaaaaaaaaaaauuguuuucucuuagccaaacaauugugaaauccuacauauuauuaaaauuaguguuucuaaaaauaugaaucaaucaauuuuuauuccaaagcuuauguaauaugccaauucuuacauaaugagaaaaugccuauaacaaaucuguacaaaaaugccuuuuguuauauuacuuguuuuaaucacagaguaaaugcugagaauaccuuaacuauaucuucagagauuucaucaugaugaaauugucagaauucuuguuuuggaauaauucuuuaacagucuuaaggaaaaaauucuuccacuuuauaaagcacacccccacccacaauuccccaaaaugucguuaugucaaauugagguaaaucuguaaaauaucaauauuaugaaugugccaugugccauaaggaguuccucaaaaaaaaaaaagaaagaaagaaagaaaaaaagaaaccauggguagaagaaacauucugguugaaaauguagacuuuuaauauaccuacacucuaaauuuugaagaaugcuuauauaugggcucuaaacaagugucaauuacuaauaacucaugucaaaacuuauuaaauauauaucacaauaaguucggagcuccauauuuacaacgucucuaucaaauggguuaaugauaaaagucugaacuuacccuuuuucagaagauaaccuuucuuaacaauguuuuuauaaaaggcauccuuuguuuuacgacggaugguauuauagauuuccuugccauccacugugucauugaguacuuguucuugauccugaauuuuaaaaaacauuaaaauuauuucauacauucuugauggaaaugaaguaaaaaucuauaaaaguaccaauuaaaagccaaagcgcuuaaaauacuaaaaucuagauacacauaacacauaaaugaucuuuugcuuuccaaagaaauucucagaaaugcuuccuuauaauuucgaagaacaccgacaacaaaguucacagaaagguuuccuugccaaucccaagaacaacuaauaaguugucuguuuccauggauaccuaauaagcuauuuucgaauacagucaguuauauuuuacagcaaaucauguuuuaaaaacauaaacuugucccagcauaacugguagauuaggaaccaauguaagcauaaagcaaauucauguuugccuaugcacaauugugucugugagaaaugcuaggugaauacagacaaccguaccaggugaacuaagacaugagaaugaacaaaacauacacacuucaaauaccuaacaguucccucaauccacuaagugugucacaugccacacccauccauccacagcugguguuauaaccaugauuucagauaauccuccucugccacucugcaacauucccaugcuucaacucuaccaauggccauuuccucauguaauguaccucuuuuuucaagguaaauugccauauuuauuguaggauguacauauuucuuaaaaaaaaauguauaaaacuaagcaacauauuuauauuagguucuuucuuaauguaucccugaugaaauuucuaaguguuaacaccccuaaccucacuuuucucaaaagcccugugguuuugauugccuaauuuugcauaaugcuaugauuuuuaggaaugcauauguuacauuauagcagaacuuacauuaauugcuaaaucuccugaggaaaagaauuauaucaggaugccuuuaucaugaucuuuccagaauaaaugaaucuucaauuuuacuauuaaggucaauuggacucaguuuuaguuuuuugguuuccuuuuugaguaguucuuacuauuuugcaaggauucauauuuuaugacuuuuaguccaucuuacaaacuucauggauccauucaauccucuuauaaaucuaaguuaugcugugggauuuucauaauccucuaucuugaaacauuaugcuguuucaucauccuaggaacuauuucaucauuacucagaauuauucccaaguuaaugcuacaaaauuacuaaaauaauaagaaaauagaagaaugaauugcuuacagcagggcugacaaacuguggcacgcaugcuaaauccaguccaccaccuguuuuuuauacauaaaguuuuacuggaacacagccaugcucauucccuaacaugcugucugugguugcuuccagauaaaaagacagacuuuaguggacacacuaaaugaacugcaaaacccuuuacagaaaacuuuugccaaccgcuggccuagaggaugauauaacugaaauaaauaaucucuacugcaucacucuggguguguguguauguguguguguaacuguguugcaaaguauugcggcaucuuuuguaaaaacauaaaaggccaucuuugcugucuuuuuagcuuugauugaacauacuuaaaauauucagaacucuuuauuuucugcucauaaaugauaaagagaaaaaaacugauccaggaagauguuugacaauuagaaaaaucagaaaacgaaugcaaagaaacagcagcacucuagacucuuaucaugauggcagaauugauuuugauaaaccucagacugugauuuuucagaugaugauauacuugaauuuucucaaacucaaucacugagugaaccauauuacuucuauuauccuguuuugcuaaaaagaaaugagacuaaauuuuuguauguacaucaaaauuuacuuaauaugauuugugaaugggcaaauauuaaagggccuuuguauaaaaaauuacugaaaguaaacauauagaaauuguaaaauucacuggauugaucacucuuauaaacaucaauguuaacugguguuuuaaaaucuaaacaaaaauauuuuacaauuauggagcaauggacacuguacucuccaacaaaauuaugagccaucagaguuuucaaaaguacugcauuuugcucacgccuuuaaucccaguacuuuaggaggccgaggcgggcacaucaucugaagucaggaguucgcccagccuggccgacauggugaaacccugucucuacuaaaaauaugaaauuagcugggcgugguggcgcgugccuguaauuccagcuacaugggaggcugagggaggagaaucgcuugaacccaggaggcggagguugcagugagcugagaucaugccauuccacuccaagccugagcaaaaaagagcgaaauuccaucucaaaaaaaaaaaaaaaaacugcauuuugauaauacaaaaacaagaaagaauaagcuagauuccaguagugauguacuuaaaaucuggaauugauaugauagauacaaugcaagaagaaccaaaguaauuacaaauagaacuuauuagacaaguaucugauuucaaaucuggaaucagaguuuacaagauggcuguguuccaggucugugcacgaagggugaagaacuguuaguugcauugaaaagacuguccauuucagguacguaaaccuuucuagacaugaaaacauggaacaaaaauuuggguacgcuacauuuaaauucuuacuacauuuuccaaugaaguuguuuuuggauuauacccuuaaucuuggugaugcgaauuauuuguaaaaugacuuaggaauauaaaaaaauuaaaaggguacacuggaccaugauguuacaaauagugaugacuuuacuuuccugguaauacagauuuguauuuaucaaaucuuuaguucaauggugauggcacuuaguauuagcugcagaauggaacauucuuggagucugucauuuaagacauguaaccacacuaauauuuggauuuaaauacuugauuccaagauuuuauauagaucuuggaaucuauauagaucuuuuaaaaaucauauuaaaguggggacuagcccacaaauccuaaaagauuccaauacacuagaagaugcuaugggcaaaaacacaacaucacuuuucaaguccuagucaaugagaggagaaaggcuucucuacguguuccuuuucucagccugagagauaguucuuagauuuuuuacauuccucccaagggaaauucaguaaucugauugguuagagucuaacagccauugaaccaagcucuucccuagaaguuacauguguaagcuccugaagacagacuuaacuugcagauccuagcuuugucacuuaauguaggaaaacgccauuuaauauauuaauucaauaaauguugagucucaggcacuguuguaguucuugagauacaucagugaacaaaucaaagaccccuauccucauggaacuuguauucuaaccagggaaagauuaaaaauaaacauaaauaaauaaauuguacuacauguuagaagguaagugcuccgcaggguugagcaaguugcaguguuaauuaaggugucuagguaaagugucauuugcuaauuugcuaaauuuugagcaaaaacuugaaagauguaagagugaggcuaguggauauccaagagaaaacaauuuuggacacagugaacagcuacagcaaagauccuaaggaaggaaagagucuggcuuauuuacaaauaauaauacagaagcaaguaugagugaaaaagaguggcaggaggauaguaggaagagacgaguucagaaaauuaauggacugccacuguugggucuuguaugccauucuaaggacuuuggcuuuuauucugaaagaaauggagaacauuuucaaguauuaaaacagaggaguaacacgaucugacauuuuaaauggaucccagugacugcugcgcagcaugcagcauaaggggacaaagcuagaaacuaggagaugaaggcagauucuggugguggucauauucuagacauacuuugaagacagagucaguaugaucuuccugacagguuagauauaaaguacaggaagaaaaaaagagaagaauugaggaugauuuaaguuauuaaccucucagcucucaguugccuuaucuuugaaauaggcaucauuguagugucaccuugguaaaguuguugagaaaauuaaaugaaugaauauguauaaaaaacagugcuuaaaauauagugcucaaaaauguaaggcauuuuuauuaugggguauauugucucaaaaggacccuuuuugucuaaugcuugccucaaaaaguguuaacaguuccaggaaguaagcaaagcuagcuaggacucugcuguuucuuagccuuugccagcaucuuagccugaguguggguacacagggucaccucauuggaagaugaggugauuugcuaacuaaucaauuuggcgauuaguaaaaagauaguauugcuuuuguacuaauaguuaaaacccugcuugaagaaugagugaguuuuauuauuccccaaacuucuacuaaaaccaacuuuucaucaccccaugcuccaaaauaauagacuacaaauagcacuuaauaguuucuguguagcaaucaaucaaauugcuuuauaaucagcaucaauuauuucugaaguauucaaagcauuauaggcacuucugcaaaaccaauuggagguuuguucaguuauaaaacuaacacaagagcaaggcacauuacauaucucaaguaauucuuaaagcagucuuauaacacauacugcaaguuuauuagaugccacauacuauuuguuuuucuuuuuuuuugagauggaaucucguucugucucccagucuggagugcaguggugcaaucucggcucacugcaaccuccaccucccagguucaagcgauucuccugccucagccuccagaguagcugggacuacaggggcaugucaccacacccagcuaauuuuuuguauuuuuaguagagacaggguuucaccguguuagccaggauggucuugaucaaaacuuaaauuagaaaauucuaaguacaaauucaguauggggaaauguaugauuuaauuuggggucaaauaaaauuaaaaucacuaacucaaagagccaaggggaauuagaauugaggauacagcaauggaacuauauggcaggauccgucaucuggaggcaaaggcaccucugauccugaaaaaagauccuagccauggucuaaaaagcacucacccauguuauuuaaaaaauacacauauauaaaacauauauauauuuauauauguguguguauguuauauguucuggcuaacuucucuuccaauuacucugcgguaauaaaaaaaaaauuacucaaaaagugaaacaagauggauguuaaaauaguauuuagauaggcagagaggaagacugacauggugauaggaaggagcacauuaaaguguaagaccuuaguaacaauacaggcaaggguaaaguagguauuucuugcuggaaagcagagaaucauucauucaaucaauauuuauugaauaucuaaugucagguacuguucuaagcacugggaaaaaacaaugcaaacaaaaaucucuguucucauagaccuuaaauucuacuaggaaagcaugcgggaaugaaggaaaauauaggcauaccuuggagguauuucagauuuggcuccagaccaccacaauaaagccagccauaugaauuuuuugguuucgcagugcacguauaaguuauguuuacaacuauacuguagucuacuaaguguguaauagcauuaugucuaacaauguacacguguuaauuuaaaaauauuuuauuacuaaaaacuguuggggcaaccaaaguggcucacaacuguaaucccagcauuuugggagaccaaggcuucugccuuggaauucaagacuagccugggcaacagagcaagacucuaucucuacaaaaaauauuagcuaggcacggugguguacaccugcaguccuagcuacuggggagccugaggcaggaggauugcuugagcccaggagcucaagguugcagugagcuacaguugaaccacuguacuccagccucagccacagcgcaagacccugacuccggagggagaaaaaaaaaaaaaaauaacaaucaucuaggacgucagugagucauaaucuuuacgcuggugaagggucuugccuugauacugaugucugcuaagugauuagggcagugguugccaaagguuggggugguuguggcaauuucuuaaaaaugaagucugcugcaucaauugacucuucuuucacaaaagaaauucccuauaaugcuguuugauaccauuuuacccacaguugaacuucuuucaaaacuggaagcauuccucccaaacccucuugcugcuuuaucaaguuaaguuuauagaauauucuaaauuauuuguuuucauuucaguagcgaucacaggaucuucacaggaguagauucuaucucaagagaccacuuucuuuucucauccguaacaagcaacuccucuuucgcuccaguuucaucacaaaaguggaguaauucagucacaucuucaagcuccacuuccaaauuuaguucuccugcuacuuguaccacaucugcagcuaccuccuccucaaagucaucuuguagucuugagccccucaaaguuauccaaaagaguuggaaucagcuucuuccaaacuucuguuaauguuguuauuuuggccucugcccaugaaucacaaauguucuuaauggccucuagaaugauaaauccuuuccaaaggguuuucaauguaccuugcccagauccauaagucacuauuuuuugcaaacauaacauuaugaaauuauuucuuaacuaaggauuugaaagucaaaauuacuccuugauccaugggcugcagaauauaagcuguguuagcuggcaugaaaacaacaaucuccuuguacaucucuaucugagcucuugauuguagaggugcauugucagugaucaguaacauuuucaaaggaauuguuuguucugagcaguagguuucaacaguggccuuaaaauauucaguaaaccaugcuguaaacagaugggcuaucaugcaggcuuuguaguuccauugacagagcacaggcacaguagauuuggcauaauucugaugcuccuaggauuuucagaauagucaacgauaauugguuucaaccuaaagucaccagcugcauuagccccugaaaagagucagucagccugaccuuugaagcuucgaagccaagcauuaacucuugccaugaaaguccuagauaauauuuucagauagaaggauguuuucuuuacacugaaaaucuguuguuuagcaccuucaauacuuaucuucuggauaacuugcuaguuaucuucuggaaaacuagcuagauguucuggguaacuugcuacaguuucuuugcuucaccguacacuuuuauguuauggagauagcaucuuuccuuaaaucuuaugaaucaaucucugguagcuuccaacuuuucuucuggagcuuccucaccucuaucagccuucacagaauagaagagaguuagggccuugcuuuggauaggcuuuggcuuaagggaauguuaucccugguuuaaucuucaauccagaccacucaaauuuucucuauaucagcaauaaggguguuucacuuuauuaaucauucauguguucaauggaguagcacuuucaauuuccuucaacaacucuuccuuugcauucacaacuuugcuguuuggugcaagagaccuagcuuucagccuauuuuggcuuucaccaugccucccuaagcuuaaucauuucuagcuuuugacuuaaugugagagacaugugacuuuuccuuucacuugaccauuuagaggccacuguaggguuauuaauuggcccaauuuuaauaguguugugucugcagaaauaggaagccccaaggagaggaagagaaacagaaccagccagucaaugaagcagucagaacauacacuacauuuaucgauuaagcuugcagucuucuucagaugcaguucauggcaccccaaaacaauugcaauaguaacauuaaagaucacugaucacagaucaacauaacauauaauagugaaaaaguuugaaacauuuuaagaauuaccaaaaugugacacuaagacacaaaugagcaccugcuuuggaaaaacagucgcaauagacguccuucuugccacaaaccuucaauuuguaaaaaaaacuaucuuugaaacauaauaaggcaaugcacaauaaaaugaagugugccuguauguuaaaaugugacaagauuaugauucuugaauuuaucuuuagcuucagauuaaugauuccucaccucccaccccaccccccaccaauuaacugcaauaaguaguagcuauagccaugugaaaugaauuuguuaggaggaaacaucaagaaacuaggcacacuacaaaucacuguacaauugcagcuggguacccaaaacccuuaauaauccuuuaugucccuagaauaacaguaccuccauuuuccacuuaggaaaauuauuaauccgucuuuugaagcaccuuuuucuaaccccuguuauaccauuucccuaccauauacuucagaaagugcaaugaggaagaaacagaagcuaaucacccuaagcguuaagcaacuaacauuuaacaggcucucuugcucaaggccaaucuuuccuuuuauguucuagauucuauucacuuuugucuaggacccugucuguaagacauugccaccacccaucuccccauacaacuucacucuccucuuuacuacuauacaguuuucacucagaguauacagacauucucaaauccucucaccguaaaacuacaggcaaauaaacaaagaaaaaguguaaaccauuuuuugcccuaauccucuucuaucaguauuuuuuauuuccuuuuauuacuccccaggcuuuaauaauccuggcugugguuuaucccugcugucucuacuuuugccuccaaaaaacucacuccuggaccuacugcaacuuaccuuccuccacgacugcuucuaaucucaaaaagccacuagguuguuccugauuaccuaaaaucaacauagauaaaaacuaaaagauucuuacaguugacuuucuaaaaaaaucuaaauaaucuguaguuuuaaguuguauccaauuugaauuguacaaaugugugcaaaaacauaccaccaaaaugcauuuuaaaauaaaaugcuaauuauugcaauaagaaaugcaacacugaccugcauugguacagguuccuuaagauaauauccuucaacaaucuguucuuuucgauagugaucuaugauguccccaaugcuguuaaaauaaaaauuucuaguauuaaucugucucauaaaacugcaaaaucuuuaaaaauauguguaaacuuucuugccaaggauuaucuaauuagcaaauuuuuuucaaagcacauaacacaaauacauuaauagaauaaaugaucauaacauucauauuauuuuagaaaaaacaauguucucaauauagauuuacaggccagaauacauggcccagauucugauuuuccauacccaucaagugggcagccaggucaacaauaccauauucaaagagucaccauaaaugaggaaaugauuaaaagucuaccuuuuuuuucacccccaagaguauauaugagauacuaagaaugaagaauucacagaaacauggcauuuauuuaggaagcagaguucagguaaauuaagaauuuuuauuaucacauuuacacauacugguuuuauaucagaaacaggucauaaaacacaugaaaagcaggcaaaaagaagaaaaaaacccccagcuaaucuuacauguaggauuaucacuauagggagaaaagcuuauuauuuugauuaaaagugcuacaaauugggaaauauugggaaaauauuacaaaaaaauaaaaugacauacuguauuuuaauauaaauuuuagugaaccacguauuuuuuuaaauauaaaguuguuucucuauaaucaguaagaucauucuauuguccugaauauggaaaucuuggaauuuuaaaccuuccuuuaauauacuggacaaaugggaacuuuugagccaccuaggaaacacuucuccagacagauuuuguuuaaccuucuauauauauauaauuagaauauauauguguguguguguguaucuucaaguauguuaucuucccuauacuacaaaguuaauuuaaaccaaauauaaguaauguuaaaaaccaaaacaaaaggaccugaaaaguuaacuaguaguguaugaaugaacuuaauaccagaagcagcauuuaacacaagccacagagggguguggugaaaaugagauaaauaaaagcauuauuaaaagaacaagcaagauuuuauguuuuuaauaaaaaaaucuaauaccauauaaauccaaaauuguuaaaagaaaaaugaaaaucaggaaauauauuugaagauagcuagauuccacuaaagagaugacuauguguuuuaaagcaaaaagcaccaaaucuaugaaaaucaguaaacaucaaagguuuuugggcucaguaacuguaaaauacaaucaauccacuguagcaccucaauguuacaauauaauuguuuuucauaaacugagagaacaggaaaccauggggaaguacaguucagauuguccaggagcaaauuuaaaaguguguggcaaccaaucagauagguuuuuaccaaugagcuagacuuaagaguuuuuuuaaaaauuacucuuccauuuauacucuacgcagaaacaccgaaauaaacagucaggggagauaaaccagaauuuucuagacauucauauaaguuccagccaugaaaucagacagauuuacaucucagaaaacuaaagcauauucaauguaaacuuacuuuugaaauaaacgugaguuucuagagacacuguguucuguauuuuaauuuuuguaaugcauuuagcacauaaaaccaugugcacucuucuucuucaagucuagauaaauguuaauauugucuccucaaggucuagccaaaauccauugucuuccuucucaccccccacugaacucucauuuauugauucccaugcauuuauauauccccugaauuuaucacauucugcauaccauacuuucuuuucuaauaaaccugagcacuaauaaagaagaaacuauaucuuuuucuuuaauguauuuacacagaauuuguacaguauauuucacaaaguagauaagucgauaaauggcugcugaauuaaauuugcuauuaaaugccucuucugcuuuuuuuuuuuaaaacucugaauauaggaacauuaaaguuaugucuuaacaguuucuaaaugaaagacauaacuacuaucccucuuuaucaaggucucauguuuaguuaauggggagaugggacagcagaguauggcuguguucgacagauuuauugaaaaaucuuucuuuauacauuuagaucuaacaauaaacaauaagcacaaagauuuaucuuccuaggaauuauuucugacauuacuaacauuaaugcugaaaugaaauauauauuuccaaaacaauuacaaaauccuucauuuucacagcaccugauucacauaauuuggggcuuuuuaaagaaguuuaauguuaaaacuagaaacaauaagaugaauuuauaaacaaauucacagggaagaaaaauuauaaaaaucaaaguucugggggaauggucaaggccacuaaauuaacauacauuuaacuuuuuuuuuuuaauccucauuuugaaaacauaauauugcaauaauuuggacagaaaucuacuuaaaauacuucuuuuuucauguuccaucaugguguucagcaaccaaaagcgacuaccuuuacauguuuuaccgacuuccuccaguauguaggaagaauuuccaguuuugugugauguaucauaaggaaguuuaaguuaguaacaaaacgaacuucaaaaaaauaaauucauguaaauuauuuuaucuuuaaaaaggaucucaauauggacauuuauucaguuaagaagaugauauauuuucagugcauuauuuuguauguucuaaaucuccagaaaacuggaauugggaaaaauuacauucuuaaagaacucaaauugcagcuagcuguauuuucagugaggacaucuagaacucagauugucauguauaaaguacucaagcaaccuguauaugagguaggcaaaaggguacagcugccuagacucacaucuuacauuugaugucuuuuaacagucaacugagcuuccagcaagcaacuagaagaacuuguuuuuguuuuuugguuuuuuucagauaaacaagcuacagaaucucuauucacucaaaugucuaguuugacaaauucuaauucagauagagaauacugcugugguacugagggguuaaacuaggcaaauauaagcauuuuagaacaagauuaugccagccucugaaauaggaaauagagaguuauuaguuauaggaaaaccuuuacguucacaaaugaagauuauuuucuauuugacugaaaaauugcugacauucuaucauaugguuucuucuauuaacuuauuuuccuaaucaaguaacuauaauucauucugaguuuugggacaaacaaugaguuuacuuugaaagugagaaguaaaaaccaacaaucacauguaagaaaugucaacuugagaagaacucaguuacaugauaacaucuguauaauaagucucagguaucuuuagaaacuuuuuuuuuccuacuaaaguaucucacugauaaaauaauguugauauauuuucuuuuccuaagauauuuugcuccuccuacagauaacacauggauuuaguaaauuuguugcaaacagcuuaugucuaauuuuuaaaaucacaaaaauuguuuuggaaggaaacaaaguauaaguuacuaauuuguauucauauuugacacugucuaaagaauucuugggcaugacuacuaugaaauuauauugaaggucuuauaauuuuuagaaguuagaaacuuuuauauaauuuugacucugaauacuguauuaucaagauuucaacuauuuuugcgaaaaguaaaagauagcuaaaaaauuaugauuuaccuguuauaauaccggccucccaucauaaacugauuguuuggcguuggacauauuuuaaaucgcugaauauuuucauugguccggaaauaaagugaauaaucgccaggaguauuaucugagggccucacaagaaaacugcagacuugaccaacuguaagaauuaagcuguuaguuuuucccuaauuaucaaauaaaaaagaaaagauguuaaguaguauuauuacaaagugcauucaaagucauaaacauauguaaauuuucaccaggaacuuguuuuuuuuuuaagauaauuucuuucaaauuuucugguuuaugauucacaaccauccacauugcuugucugcuaucucucugguguaucuuaccagcuuuaauacauaaaaauagagagcagaaauuuugcagcaguaacuucuggucaguaauaucuacaccuguccuaauuuggaaggaaccuaagcauaguuagggaauacuggcuaaaacugcuaaauucuguauguaaaucuucguaauaagaagauucuaaaaagugaagaccaguuugcuuaagaauacucugugcuuaaucaauguuuucaauuaaucauuaaacaguaaugacugugcuaggcacagugguacaugcauauaaucccagcuauccaggaggaucacuugagcccaggaguuugauaccagccuggacaacacagcaagauccugcaucuuaaaaaaaaaaaaauuaaaaaguaauaacuguaauaaaauaguaccaaaagcuuuuuauaaagguagauucaaaacaacugaaauauguguauacauuaucaaaaaucaauacacauacacuauauuuuauucaauagguaugcuccugaaaggaauuauagaagcaaauuaucauauauuaaauaugacauuaauuuuagagaaguauuucugauaucuuugauuggcagugacucauaauacauagaugcucugccuuuucuccauuuaaguucaaaugauccagaaaagaucaggacuugauuguuuuuaggaaagcacaaugaaugcuuagauuauuagauauaauuugagggguaaauuacuaauaguuccaaucauccaaucaaggcacuuaugaaguaacuucauguucaguaaaaagaaaaaaauaaaucuccuuaaacugaaucuucaaggcuuaauacauaaguaaacauaaaaauuacagaaauugauuguauaauaugggcuaaaaugaaaguguuucuaaguugauacaacaaaucuuacugacaagaauccaagauacucucuaaauuucuucuagaauaugauaggaauuucaugcaagacugugcaugcaagugcuuauuuguacuucucaggagagaaaaucccaccagauccucaaaagagcacaugacacaaagaaaaugcaaacuaauguauuaaggaaauuaaguuuagcuccuuuucaaccuuguaugacuuaaaacaaaaguaccucaaguacuuggugguacaaguuccaaaaaagaaacauauccaaaauucaauaaauucacuaaacuacauauuuuugguuccacacugaaauagcugacagaaugucauuuuaguuuaaaauuucuucucuauuacuaucauauagcauuaucauaaucuuuuuuaacuuauuuuuugaaccuacuuaaccuacagcuucacaauaaaauugaguacuucaaaaacuaucucaaaucuuucaaaagaauaaaguauuaauuuaaaaugcagugcuuuauggauuaaaacaauucagauuaccucuauaauuaggguuaucaccacaagaaucuauuucaccaaauauagaaacuauugaauagucaacauuuuugaagaacugaaacuuuuaaauuacauacuaaagcuuaaacuugucugaaaucuuuauaagaugugguuugccaaagaaaugcucgguauuuaaauuaauucagccuuaaauauuuaguaagaauaaacaaugacaggaugguuaaaaccacaauacaagucaauuuuuacuuuguauuuauaagcauaacaguuuugggaaauguuaaaauuaauacauacuaaauaaagcucaaucauauaauuccacaaguauacaaagauaaauacaagaaugucugcuguagcugaacagcaaaagaauaaaaacaauacaauaucguucuacugaagacuaguuaauuaugguauuuauauaaugaaaaguuuaaauccauaaaagagaguaaugaaaguuuuuaucugcagauacagaaucaucucccaauauauaucuaacaugaaaaaaguguguugcauguuccugucuguguauguguaggggugagaaagauucacagagacacagaaaacuucuagaaacauaugggaaaaaaaacugucaccuaguguuacuucugaggaaguggacaggggccugggguaaaagaaaaacacacuugacuaaauuuuauaacacauguauguuuaaaauauaaauaaaaacaccagcuucuuaguacuggacacgaaauuauaacaugcauaaacacuaacugaaugcuaaaggcaaaacacaugauaaaugguuuguucacuuuuuuauucucuuuaaauagacauuagaaaagcaaguaaauauguaaguaccugucauuaguaaauuauaagcuuccuguuuggaaaucuucccauggaaccaucuuaaaaagagaauaaauuagauauauaaauaaaguccuuuuugcuguuaucauaugaucaaaauuaaacaaccaauauaguaaguuuaauucaaagugauaaaauaaaugcaauuaaucaaaucaucucauucuuauuacauuuuaauacauuuuauauacauauuauacuuaauuucaacuaaagauaguaaaacuagaaacuaucaaauauaaacuacaauuuucauuaccaauacaaaaauggcaacaauuuuuaauccugauaauaacagacuguuauaggucuuuuuuuucuuuuugugggguaaggggaaggaggaguaguacagauagagccuacuccagaacuucccugaaaaaauuaaugaauucauuucugaauuuuccuauaacaucugauaaauucucuccucaaauaaaaucaagauauugacucuuacuuugcugaaagucagaauauaagauugggugauaagaaugaguggauagcaccaucaagaacugaaagaaaagaaggacuuaguguucucaacucuauuugagcuaacagccuaucaaacuagguugcuauguauuuuauauucuguauucuuaaauuaagccuuuagaaauuauuauaaaaggcaucauagucaagacauagagcauacaauaaccuaaguauuuaaauuuuaccuucaaauaaaaggauauaucugauuuaaaaaguaauuacuagucaucaaaguacauaaaaucaccucuuauuuaccuaaaggccuauuaucuaucuugcugauuaacacaucuuaaugccaggcugacaauucccgaucaccuaucuacuacuuugugggaucuucuuagggucuacaaguauuuuuaauaauaaagagcaagcuagaaaguaaauauacgacuaaaauauauaagugcucaaaaguccagugugacagguucagaggucauucacauuguuuuaaaugauccauacaauuauuacuggugaaguaugaaaauauaacugaauuuuuaaauuuucacaugaaugaaaagguaaacuuuucuuuaacaccauuccaagcauuaacucacugauucagaucuccuggugcucccuguguaaauuuugaauaauauaaagcaagaauacaacaacuaaaacaguucagacuacaaguagugagguucuauacugcauucaaguauaggcuaaaugaccacuuacuacaaaugcuagagcaggauuuuuauauucuggaggacagucaacuacaugaccugaccuccaaggcuaauccucuacuucuacaguuugaaaaaaauucaaaaaaagaaggguaaaaaagugauaggguuuacagaugaacaagauuauuuagcauaagcacacagucugaagccaaaguggcaauaucucuuucuaaagaguuuucguuucauuuuucagacauuuauucccauauaaaauuuauauauuucaaccacaugguuugcaacagugauaaaaagaugagucccugcucuuauaaaguuccuacuccuaggccaggcgugggaacugggaucacaccuguaaucccaguacuuucggaggccaaggcaggaggaucucuugagcccaagaguccaagaccagccuggcaacauagugagacccuaacuauagaaacaauguagaaacuauaauaagcacagugauagguauugccaaaggcauuuugggaguaacagagaaggguaccaauacuguugaguguguagagaggaaaauaaaggaagauuuucuagggggaagugaugaaugagcuaaguaugaauggaagaauucuggccuaggaagcagcuugagcaaagguauaaagaaaaauagcuaggagcaauggcucacaccuguaaucccaacacuuuggaaggccaaggugggaggaucacuugaggccaggcguuugagaccagucugggcagcauaguaagaccucaucuuuacaaaaaaaaaaaaaaaaaaaaauuacaacauuugccagguguggugguacacaccuguagucucagcuacucgggaggcucaggcaggaagaucacuugagcccaggaguuugaggugaacuaugauagcacuacugcacuccggcuugggcaauggcaagaaccuaucucuaaaacaauaaagaaaaaaguauuaugaauuugaagaccuacaugcuggagauuaggaaacuacagaugauaagugcuaggaguaguaaacgacaaaauaaccagauaacagaucauuuuuuaggcucugcuaagguaaagguggagaaucaguauaagauucaauuuuuuaauuuuuauuuuuucuguuuuuauggguaauguauacaacuauuuuguuuauuuuuaugggguaccagugauguuuugauacaagcauauaauguuuaaugaucaagucaggauaaaugggguauccaucaccucaagcacauauaaucauuucuuuguauuaggcauauucaaauuccacucuuuuaguuauuuuuaaauauccaguaaauuagaucuuauucauucuaucuagauguauuuuuguaccuauuaaucagccauauuguauccccccuucccugcuacccuucccaccuuuugguaaccaucauucuacuaucuaucucccugaguuaauuuucuaauauuuugcacccauaugagugagaacacaugguauuugucuuucugugccuggcuuauuucacuuaacaugguauuugccaguuccauucauguugcugugaaugacaggauuucauucuuguuuauggcugaauaguauuccauuguguauauguacuauauuuucuuuauccauucauccacugaugaacacuuagguugauuaaacaucucggcuauugugaauggugcugaaacauaggagugcagcugucucuuugauacacugauuuccuuucuuuuggauauauacccagcagugggauugccggaucauaugguagcuuuauuuuuaauuuuuugaagaacuuccaugcugugcucuauaguaacugcacucauuuacauucccaccaacaggguacaaggcuucccuuuucuccacauccucacuagcauucauuauagccuaucuuuuggauaaaagccauuauaacuggggugaaaugaaaucucauuguaguuuugauuugcauuuaucugaugauuaguaaugaauggugagcauuuuuucauauaccugcuggcaguuaaggauaaugugauucaaucuagguagauuauuccagcuacuggaaaaaaggauuugaugaggcuaaagagucaagggagaucaacuuggagguuacuguuauaucaaauccuggcaggagauuuaaaaaguccugaacuagaauguaguuauuuaagauuugagaaggcgguaaacauuuaagaaauacuuuaagagauaaagucaucaggacuuggugcccauaucauguaaauagggagcuggaaagaaauucaaccaaaguuauaccaucuauuuaaucucaaagguuacuuguagauguuacugaggacacuuuaaagaauuuaaaguacugcgacagucccuauauuaggaaauuaaagggaacaaacauacacauaaaauaaaccaacaaugcaaauuuaaguuaugccccaauuaagaaauuacauaaaguuaagaaaaauggaagaaugacaaugcuaucagauaaaaagacuuccgagugaaagugggauuuauauuuuauacuaugagaaaacugauguagcuuuaaauguuuacuagcauuuaaccuauauuuuuaaauuuaaaauuccauugcuauuaucuaaaauaaaaaaaccuagauuuauggucuuuuuuugaaaaucagaaggaucuaacaacacuagacucacauuccuacacauaucaacuagacaacuagacaaagugauuaccuuacaauaggcaaacacuuucuaguuuucuacuucccacaguuuucccuaacaccgugagugaauauuaguugccauuuauuaccacacguacaguguuguuuuuugacaguagggacacaguuccauguaccuugaucucuagcaacgagggaaaauaagaaagaucaagauuauugugucuaaagaaaacugggaauauauauacuugacccgcuucacuugcuuacauugucugucugauucuuccaagcauuaauuagaauuugcaacuccuagcugggcacaguggcucaugccuguaauuccagcacuuugggaggccgaggcugguagauuacuugaggucaggaguucaagacaagccuggccaacauggcaaaaccgcaucucuacuaaagguacaauaaccagccuagcaugguguugugcgccgguggucccagcuacucaggagacuaaggcagagaaucguuugaauccaggaggcagggguugcagugagcagagaucgugccauugcacuccagccugggcaacagagcaagacucugucucaaaaaaaaaaaaaaagaaaaaauaacaaaaaagaauuugaaacuccugauauagguagagaggagacuucaaacuaauacaaacagcaggguacagucucacuaauggaaucuauuuuguagcuacaagaaacaauaaaaaugaacucagaauauaucuuacauauuccacuuacagaagggugaagcauuaaacaaggugacugcaaauggaguagucaguugaauguuuuuauauucuaaugguuagaaaacagaaaaagcaaacacuugaggcaagccucaaguuccaucccuaaaugcugaaagauaagaaaaaauguuguacugaaaagauauuaggagaugaauagucuauuaaaaugugaguaagagagaauugggauuaaugguucagaucuucaaaagaaaacuuacauauacauaaaaucagucugaagauuaugaaaaaaaaagaccuugcugaaucuuauuaaaauugugaagaaccguuauuuuggggggauaaaagauguggcuauaaaacaagaaauacuaugaauaaccaagaaauacuaugaauaauuuuaaaaugugccaaauugugacauucauaauguuauaaauguaguguuuauucaaagucuucaguguggugauaaaaagaguuauauuuaguuaucagcuaccuuuuauuuaaaaacaagacuuuaucacuagauccuuaagaaaauauuuagaaaucaguucccuaagccaaauuuaaaaguuaagucaguccaaaaccuuaaaaaacaauuuuuuuggccaaaguuuuccaauuaguaaauuuacaauauagauuuuuuuuuucauuuuaauaauuaacacaaacucacauuuuuccuucauguggaucuucuucccggcccuaaagggaagacauuaagacaguauuuuauauaauuaacuauuaaucaauuuuuauuaaaauucaugaaaaucguaucugcaaacauauccccacacuauccuuauuuauguuuauauaaaaaaagauguuucuguucaguaaauaucuuuccaaaccucucuuaaucuuuucuuguugccauuacccuaacucaggcccucuuaucgacuuuucuuaaacaacagcccaacuaauauaauuauguccuacuccaccacucuaaucuggauacaucaguuucaacagcagcugugcccuacauuaagaaaaaccaaacaaaaaaaaaacaccucucuacugccuacaaauuucucauucugcaacugaagucguuuaccacaggacucaagucuacauuuccugucucauacuaccaauuguuuuuugguuccuauaccauggucacacauaacuuccuauuugccaaucucccaccacuguagcuuguacuuuuuguucuuagaauguacuuuccacuuuuugcuuucuacuuguuagauaaauaccuaaccaaucugggaaggaacuaucucaaaugcuaccucuucaguaagacauucugagcccguaaaaagugaacaucaacuucuacuuucaauauaaaagacaucccccuuuuacuauguuuugaacuuuauuuuauucuauauuccucugauuuaagauacaauaguguuacucauuccacuauuauggagaaaaauggucuaacuacauguggauuuacuucucacaauuugguccucacucauuaaauaccuaaucaaacuaaaaucaaacacucacugaauguuacuauauccaagggaguaggcuuaaaaaaaaaaacuauaaaaaugaauagcauuaucauugugucacugcccaaaaggaguuaaucucuuguagaagaguuuuacacaauuauuaauuuuagacaguguaacagaaugcagaauuagcaaggugcuauggaaauacagaaggaaacaauuuugccuaagagacuccagaaaggcauaaauccucugugaaacagggaugacauaugaacugagcucauaaagaugaaucaaauuuuacaaggcaaucuaucagggcaagaaugucaaggaagagggaaaacuauaaacauagaaacauucauuuacucaacaaacauuuucugaaugccuacuaaugccagacacuauucuaggcaaugguaauacaucagugaaucagagacaaaaaucccuccccucagagagcauacauucuagaguuaauacaugaaaguauaaauguguuuggggaacuguaauuagaauuuuagaaggagaaauuccuuaaaucuaaccacuaacugaaugcccgaaacaucuucacagacuagacaauguccaaaugguuuuucaaucuacaaagaauucacuacccucuaauaaagcccaucaugaaaguuauucuacauauuggagugaaaauuguuuauaaaugacguggaauuacuccacuauuaauuuauaauguuacuauauucauuuuuagcaaccacaucacauuauucacucauacugaguugcuaacuuuuuccuugaucccuuguacugaugugaggucaugucuccuuauucugguuuggguuguuauuauuauuuuucuguauacauugaguaauuuucacuuuucuuuaaagguuaucuuguuaaauuugauccagaauuccaagagcucaagaaaaguucaacuauagugcaauuucuugaaguaaucaggauggagaagauggugguacagcaaggagagggaaacccaaacuaaaaguuguaacuaacaaauuuuauaggaaaacuaucauaguaagaugcuucaguacgaauacuguuugccuauauggaguaaauaucucuuuuacuguagaauacagaauacuaaucuaggaauuaggaguccuaauccuagcucuuucacuaaauaacuauaugacuaugaguauggacuguaucacaccauuuccucaacuuuucccaccucuacucaguauguuuuacuucuauggaucaagauuugguugccagaauaggcagguaagagaauuaauaggaaaaaacaauauucuccacugcagucuuccaggagcaauacucuucagaauauuaucaggucuguggcauaauuuaaaaacaguagcuuugaaggcuguaaaagacaacagaaagccacuccaucucacuagaaaaauccgaaaggaaagggagaauuccaaaguuauaauguacaauauauuugauacugaguauugucucugaaauauaaaagccauucaaaugcugaccuguuauuaaaaaugcaccugguaauugauaccaugauaacguauuauaugauggaaacaaaaacaaggacgagauucaaaauguagaaccaugugauaauauauguauaauauaaaugaauucuuccaaguuuacuggaaaauuauauauauauuugaaagauaaagaaucuaaaaccaaacauguguaaccaguugagguuucaugaucagacugauauaacuucacuuaugaggaagaaaaggacggcaaaaaaaagaacaaaaauaagcacaaauaggccgggcacuguggcucaugccugucaucccaguacuuugggaggcuaaggcggguggaacacuugaggucaggcguuugagaccagccuggccaacaugguaaaaccccauuucuacuuaaaaaaaaaaaaaauuuuauauauauauauauauauauauauauauauaaaauuagcugggcaugguggcacaugucuguaaucccagcuagcuggguggcugaggcacgagaaaugcuugaaccugggagguggagguugcagugagccgagaucacgccacugcacucuagccuggguaacagaccaagacucugucucaaaagaaaacacaaauguuaauauauuuuuaauucauagaaaaucauacaagcuuucugaauauuggcagcuauguauuauaauaugcuagccugauuauguuccauacuaacaaacagcacuuauaauucuuguacuuaucaauuaaguucuuuuauaaaagaaauguauucauagcuacuuucucugauuacggacaagauccaaauuuauaaaauauuuagaaucuagaauugagaagaaaagaacaaaacuuaccaccucuucuacuaggucuucaacaauaaggccuuguucaucuguucuuaaauuuguaacccacauccauccaucuucuaauucauuaugaacaaugaacauaucuccuuuuaagaaacugaaaauagcaauuuuaaaguuauuaaauuuaaaaauuuuaaauacagagauuagaauagucauauaccacaaaauaggauagggauaguauuauauugaaaaauguaaggaauuagagucaaacacccuaaauuuguauccuauuucuggcauuauccacaugucaauuccugaaaauaauaaauaaucugaauuuuaauuaccucaugaguaaaauggguuugauaguaguaucugcacuaacuauaucacugaauuauuguuagauucaaauuacaacuucuguuaacagaaacugauuguacauauauugaagguuuugggguguaacuacaagaaaacugaauugaaaaacuuaugcuucaauguuauuacucuuucagauguaggguagauauaaaaucaaaacacaaaauaaauauaauuaacacacuauacauacauaagauauagaguuacuucagaaaauguuuauuuuagauaagcaugauguagaugcuuaugucaguuaacauuuuucuuauaaaaaaaccagggcuuguuuaauucacccagauacccauuauccaauggguacagcauucuuucucugaaagugguagguaccaagggauauauuaugagaaaggaauguauguuuuuuuucuguuaccaauuuaagaguacagagaugcauauacaacuuaguuuccuuuuacugaaaccuagauguuuucaaccuccacacaauuauggaaacaacaaguugcugauguauuucaucaauauaaaaccauuaguaauucuugaauuuguccuuucaggcuuaaaagaaugcaucugaauacaaaguuuccagauuuguuggaugguaccauuaacccuguaucuauaacuguauuugucuuuuuuuccagcaauuuuccuuucaaucuuaauauucacaaaucaaaaucuauuaaguaaauuuaaguaaaucucuucuccuauccuugaaagcuuuaacugcuuucucuaugcuaucucaagcuucauuguaucuuggacaauguuucagacaacagaacuuguauuauacaacauuuaacucaauauuugaauaaucauagaauauuguauucuaucuugauucuacaauccuucuuaaugauggccaauauuucacuagcugaauggcagcagacauuaccacuuaaccaauuaaacuauuccuuucuagaaccaccuaaauaagcacauuaaagaaaaucauuaugaguaaaaggagggugcacaugaacugguaaauuucauuucuuaguuaaaaguagccauaagagauauuucuaauuucaaguuucauuguuguugcuauaccaacuuuucauggugcaaaaaccaaaaaaaguuuuaaauaagcuuguuaguaguaauacaaucuaaucauaacucauucuauauuauuuuguguuauccccccuaaaacaggcuaaagugcuuuauuaaaucauuaauuuuuaagguauuuuuauuuuaaaauccacagguguguauaaacuuuuuaaaagacucauaaauccaaauuuauaucaucaaaguauuauuuaaauucccaucuuccuagaucagcuauuuuuuuuuucuuuuuggucucccaggaccucuuuacacucuuaaaaaugacauccuaaauggcuuuuauuuauauggauaucuacugauauuuaccauauucaaauuuaaaacaaauguuugaaaauauucacuaauuccuuuaaaaauagcucauuaaaaauaugaaaaagauacuuuuacaaauuuagugagaauaucacuguuuuauaauuuugcaaaucucuuaaugccuggcuuaaaugaaaacugcuggagucccauaucuguuucugcauuaaauuugcugcuauaugauuuuuuugcuuaaaacauaugaggaaaaucuggcuucaccuaagaauguaguugugaaaaggauaaguauuuuaauagccuuuucugauaauuauagauauucuaugaaauuacaccaaaaacucaacgagugguacuuucuugaagguuaguuguaauauggaauccaaaacuauuuaucagugaacuuuaugcauuccaauaacaucuauuggucuaucuugcacuuuaaaugaaucuuuuacccaugcauaauuuuguaacaacaugcguugaccuuuuagaaaauauuaguucacugagcuaucuauaucuucuaguuguuaacacauuauacacuaucaaaaccucucauucuuggccagccacgauggcucaugccugcaaucccagcacuuugggaggccaaggcgggcagaucacccgaggucaguaguucaagacuacccuggccaacauggugaaaccccaucucuacuaaaaauaucaaaauuagccaggugugguggcagacgcccauaguuccagcuacucaggaggcugaggcaggagaaucgcuugaacccagguggcggagguugcagugacccaagauggcaccauugcacuccagccugggugacaagagcgaaacugucacaaaaaaaaaaaaaaaaaaaaaaaaaccucauucuuuauuaucuucaccuaucucaucagaaaagucauuauuucagaagcugucaaacucuugauggccaauacagaaugucuaaaauucaaauuuuuacucaaaacucaaauuuugucauuggcaacaaacacuaaguuuucuuccuugaaauaauagacucacucuguucuucuucaaaaaaugucaaacauucucucaagugaaaauggugugcacaaaaguaacagcuaagccaggugcaguggcucaugcccauaauuccagcacuuugggaggccaaggcgggcagaucacuugaggucaagaguucaagacuggccuggccaacauggcaaaaccccaucucuacuaaauuacaaaacuuagcuggacuuggugacacacgccuguaauuccagcugcucagaagaccgaggcaaagaaucccuugaacccaggagguggagauugcagugaggcaagaucgugccacugcacuccagccuggguaacagagcaagauucugucucaaaaaaaaaaaaggaacaaacuaguucagcucucaacucacugcuuuuccucaugacacugaucccugguacacagcagaaguguuuuauacauacuucccauuucaucauacagauuaaaguuguguagucacagguugaaauucaauaaauauuuuuuacucccucaucaacaacacucuucaaugaaacugucuuuaacucuaaguguguaacagugaagaauacaguacacuuuugugccacagccuugauuucuauuaaggcaccagcaguuuuaccauccauugcuuuuguaccaucauuguaaaauuuacagugaaaaaggcaaguuaugucuuaguauguuaugaaaauaaucugaucucauggacugugauggcuaauuuuaugugucaacuuggcugggccauaggguucccagauuaaacauuauauuucuggguuucucugugaggguguuucuggauaagauuagcauuugaaucagaggacaguauccugccauccccaaugugagugggcaucauccaauucacugagggucugaacagaacaaaaaauggaggaggaagaaauucaucccuuucugcugccuuacugguugagcugggacaucucaucucaucuucuccugcccucagacuaugauuuacaccauaggcuccccugguucucaggucuucagauguagacugaauuauaccacuggcuuucuuggguuuucagauugcagacagccgauugugggucuuuacugucuccaucuaucauuguguaaaccuauucuccguaaaaaaaucuccucuagagaacacugacuaauacaugaaccuucuaaauggaucucaaagauccccauaguuacaugaaacacacuuacagaacugcuguccuaaaugaucccacuaaaaauuuuuuaaaauuaccuaaauucauaaauuuguaauucaucccuguucuucaauauaugcauuuuuuccuuugucauuuauaggccuguccaguuuacauuacaaauaaaaaugugucaguaagaauuaaaugagagaauuaaugguaagaaacaaaguuuccacuagaaaauuaaauagcuuauagaaagacacagauaaucugauuaucaaauuauauaauuauauagaaauaaaaccacaaacuaacauguugcauaguucuauaacauuccuaagguuuaaaauuauucacccauuacauaaaguagaagcuuauccuuuauagcuguggcauaaaugucacaugguaacaaaaauuuacauagcauauagauugaagcagaacucuccuuacuuugugagagacaguggaauaaaaccuaacuauuucuccuaucauauucacugaggccacccugauccaaaaccacagucugaacaaauaagccaacccagagauacaggaccaacagacccaauaucaaaagcucuuucaccuugcuguaugccauuucuucaaauuucaaaagcuuccuaguccaagaguaauaaaucuucgaagucuagcucuuucaaaugccuauacaugagaauagauuauaaaauaccuuauuucaucagugucugguacuuuuguguaagguagaauagcucguacacgccuucuaucuucuacuggcuagaaaccauaaaaaaaaaaagauuuaaaaagauagucuuuuuaucuuaaagucaaaagagguauauccacauaaagccaauaaaaauucacauuagaaacuccaugggaucauucaaauaaauuuuuacuuggacuauaaauacccagugccuagaaaggcuuuuuuguuguuccuguuuuuaugaaaaucauauuuuaaauauaagcaguaugcuuuuauaacguaauaugaaugaucauuucauuuuaaauauacuacaugaaacauauacauuaaccuuucauugaugauacacaaggcauuucagaaucuugcagcaaagucaggguuaauacuaugaaaucaguaauuuguucccauacauucagaaauauuuguuaggcuaucaccauacaguauuuucuuuuaaucugguuacuuaaauacaaaauuauugaaaaauauuuucuuuuuuuuucaaagaaguuguccauuuuguucugacauuauaacccgaauuaaaauuuaauacaacaaauacuucuugaauuauaauaaacauaagaaacugagcaauagcuaaaaccauuauuguacugaaaaaauaaaguuuugaaagauauuuuauucauuuuacuugccucugguggugcaacuggguaaaguaauuuuucuccuuuaagcaaacaagaaacaugacuguaauaaccuauuaggucugacagugaagaaaaacgucuuccaccaauguaguaaucuccacacauagcaauaauccuauuugaacaggaaaaaauacaguauaaaaaaaucuuuacagccaauuuuaaaaaucaaguuuuauaaagaaauuauaaauccauaauuuccauacucuuuuccuuguaacuauauccuuauacuaaaauaccacuuauuaguaucuucaucacaguaaauuacuuggggcuauuucucuuacauauauauacaugcauuugaugugaaauacauaucaggcuuauaaaccucaauuacagaauuccaucaaauaucugaaaacucacccucagauaccucuucucacuuuccauauuuaaggcugaauuaacaauuuaauaaguuuuauauggcuaaaaggagcucacagaucucuugcaauauuuacacaaaguacaguaauaauuucacauacuacaugugguaucaugguacuacugaaccuuauuuuaaaaucuaaaaaccaaggguacacaaacauuuuaucauuuaacacuauaugcauuagaugauuuuuuucaauuucuucuauaaaaaugaaacaauacaauauggguaaauauguuuauauauacagaauauuuguacuugaaaauuuauaugucuguuucacugaagugcaugucugcgaagaguuuuagaauagugaagcuaaaauaaaggacacaaaauuugaguuuuaaacaggguuuccuacacuuuuuguuauucugcagucuaaaaguauacaauuccuuuauuuuagccuuaccacucaaaguuuauuuguaauucuuuauacuuuaaaaacuauaaauauauuugaggaucagcacaguaaugcccaacaauauuguuuuuaaacaaaaaauguaaacauucaaaagaaucucucuaaaucacugauuaaaucauuugacugaaaacaagcuuccuucucuauuauuuguuacugagucauucaccuuuauuauacagguauauuuaugaauauuauaucaaaauagcuacaucauuuggcuucauaauaggaauaaagacuuaccuaaaaugguugacaacauucaucuggcuaagaaaugaaaguacaaaggacccuggccuccgaucacucucucuuauaagauaacugccagacuucccugccugccugaggcguucuucugcuaucguucugucaaguuuuccgugauaccaccuaggggaaaaacagagaagauauuacaauauaaauagcaagugcagaauuucuauggacacuugaaaaacauacuacuagagguuuuaaaugccuacauguaacuuaaacauuuacauuuuacucugaaccaguuauuccaauuuuaacucaauuuaaccucagucucaaaaaauacucauuuacuuggucuuuaauuuguucuaaaagcucaguccuagucaucucauauauaaaucucuuccauuucuacccaucucccuacuuccaggauugccugcuauucaaaauauaaacacuacugcaaccagaucuuuacuuagaaaaauaaaagauagacaaauggaaaugauuaauuuacuaccucgaucuuauacugaggaaccaugacuucacaaggcacauggaaccuaugagaauauaaaauguuuuauuccauuuuaguguuugugcccugcgacaggaaaacagaauuacacugucuaaaggaugcuauuuuaauuuccuguuugaacgugaagcugauuaaucccuuuggcucuaagauaaucuacuccaugacuauacauuuuacauuugcacucaacuuuccaaauuuauguaacaaacaugugggagaauaaauagcaccuuugucccuucacccuucuugcucucaguuuaacuguguucuaccuacauacuaucaaaugaucuacuuaagaaacuggcuguaacucuagcauaccaaguaugccuauaaaagccucauggacugauauaaacagaaacaugcuuagaaauauacuagaaguaucauacaggcaugguaacaaaucuccaaaguaauugcuauaaaauauuuuuacauuugauaguuuagccaaacucauccuuagauacuuacagccuaauuugaaacauccagagaaaaacaauaaacauucauauuacauugauauauucaauuauguaacauaauauaguacuucagcuuuaccaaaguuuauuuguaaucuuauauguguaauaauguauguauuuuauauaauauauaagccaaugauaaaagcauuauguuacuaugacuauuuuuguaagcuuguuguaauaaaagcccauuauuuuugacuccuuaauuuuuaaaaauaaaacaaaaacacagaaacuuaaaacuuauggaaagaauuacuuuuaguuuucuucuaaaaccaagcuauuuauuuagagcccuaugcauaaggcugaaaauaaugaacuuauuuauagcguuccauuacgacuuaacaaacaaaauauaauuguaaccuguuaguacuagaggaagaagggaaagaacaaucaauacugcauuccucuaaaauccuaaucuuaguucagccauuaucuuugagacaaaugacaaguaaauuuaacuuucaagagcucagggacuuuuuaaaucugaaauggaaaguuuacaccagagaucguaaaugaacccuaaggaacuauaauuuaacgacauaagagaauaaaauuuugaaauuucaggcuaugaguuuauuuaguugugaaaauauaugggauauccuuagguuauccuuagaauaugaaacuagugcauuccucauuacuuaaagcaguagaacuaucccagagagcagauuuauauacccaacaaagauaaaauuaaggacaauuuuuaaaaaucucuauuuuuauauacuuguuauuuguuaaauuucuguuaugucuuagguagugucaagaugaaaaagguuuuucuuuaaucuccuucaucuuuugaacuuaccauugaaaugauacacagagauacaugaggcauuacacaauuacuacuuuauaagaaauauccaacuuaugauuuuaaguaauauauauguuuauuugugguuuuuaguuguuuuuguuuuguuuuguuuuaagacgggagucucacucugucgcccaggcuggaguacacugguacgaucucagcucacugcaacccccaccucccaggcucaacccaucuucccaccacagccucccaaguagccgagacugcagacacaugcuaccacauccagcuuuuuuuuuuuuuuggagagacagaguuuugccaugucacccaggcuggucucaaauuccuggacucaagugaucugcucaccucagccuucccaagugcuaggauuacaggugugagccaccacaccgagucgauuuuuuacaucuauguacuuucuaagaucugagcauuaaaauggauaagucaguucaggagaaagacauuaaucuaaauaaguaacuauuuccuaaauguuagcaauuuccuucaugucaaaaggucguaagcuucaaacacauaaagcaaaacaugucaauucuugauuaugacuauaaacugcaauuaaauuauccagccaucagcuuguaaauauuuacuuaguugauuugauccuuaaauguuuuauaaauaaaucacaauaaauccaauguuacaagauuugauucagacaccuuacagauuucuagaaccuaaguaaaauacuauauaaccuuuaaacaccaguccuuggguuuacucaaaaacaguauuucucaaccauuuuuuaacccacaaucuuuuauauaaauauaaaaauuuuacccuacugagagauucagagucccuaagguggcuguccugcauagagaaucauauauucuaauuagccccaguagccaagaaaaugcugucuaccuuaacuuucugaagucuguaauucuuuuuauuucaggugggauauggcuuuacaaaacauacucucaauaacaaagauauaacauuucccaagagugaacacuuugggagugguuauuugucuaaaauacucaauuuuuaaaaaugcuacacuuucugccucuacaaauagucacagcaauaaaauuacaaagaaauacaagaaaacauauuuaaucaaccccacuauuacucuuaagucuucacagucaaagccuuauuauaucucuuuaaaaguagauuugcuggugaccguuuucaaauaaguuuaaaaaaaaauucaacuggaaucuagaauaccucaaagaaacauaagcauaagaaucauacuggugguaugagaauacucugaguguaacaugagauuacuaaacaauagcucaucaucuaaguuaaaguuuaucaaucugcucacauuuguggcaauuauaacacagaauauaccuggcacauagcaauaauaaguuuuaaaaguauuuguccaaugaaagaagaaguguugacucauaaaacaauguugaaaaauacuuuauaagucaucuaguuaaaccaccaugccaauguaaaaaacaaaacaaaaacuuuucuuuuuuaacguccacauaggaaguucucucucuuuuuuuuuuuuuugggaaacggagucuugcucuguuacccagguuggggugcagugccaugcucuuauggcucacugcaaccuccgccuccuggguucaagugauucuccugucucugccucccaaguagcugggauuacaggugugugccaccacauccggcuaacuuuuguauuuuuaguagagacgggguuucaccauguuggccaggcuggucccgagcuacugaccucagguaaucugccugccucggccucccaaagugcugagauuacaggugugagccacugcacccagccaaaaauucugacaugugaaaagaaugugaaaacaguuuaggcugacagaacucaaagaaguaugauuaugcugacacucccugagcuuguucaaaagagacaaugcauacuagcagaagaccaagacuuaacagaaacccaagaaaccuccaaucuauggcaaugccacccuaaacauaccaaaucucgucagaaacugucuccacaguuacggccaagucuuuacauuuuuuaugucguuaccaucacuuguaaauuagggaaauuaauuucuaucucaaccucagaauaaaauuaaugacuuguacuaaauuccuuuaaagaaaaauacaaaaaugaaaaauacuacauaggcuuuauaguagaacgguuaaaagacucuagagucacugucuuugaaucccagcucugccaccuagcugcgcaaauguaggcagauuacuuuaucucugagccucaguuuccucaucuauaaaaggaauauaauagugucuaccucagagaauguuggcuuaauauuauuauuaaaugagcuaacacauauaaaguugcuuagaagaauaccuaauggauaccaagaacccaguaaauauuagcuuaauuaauaucaaaccaguaucacaggggaguagaggauacucaaaggauaugggacugauuaauaaacuucuucaaaaaaacuaacaaauuuuaugacuguugcaaaaugggugaucaaucugugaaucaucuuagucucaauuaccuauuuuccagucuuguuuacuuuccaucuaauuuggggaagagaacaggagaaaccaaucuuuuuuucuacuaaggcauuaauuuuaggaggaaauuuucucaaaacucuuuuugaacauuauagagcauucaaauuaauuggggcugcaagugccauacuauuaauaaacuagaaauucuauuucaccuggcaacucuagaaggaaacccccaaagagcccccauucuuuucccaauguguguauauuuuggguguugggggcaauauaaaggauaguauguacuugagauacuaugacuuaaaacugcuuaauguaacacauuaauaauaaagcauuuaauguucuccuauuuuaaaaguaaaucucccucucucuucuucuuugccucucuaaggaagauggggaaaaggaauagcaggaggaaauucaagaaguacauacaugucuucccagcuagcuuuguaaauuuuuguugagaaaucuuacagguagauauggagucccuuaauuucauuuuuuuagaaauacaaaucaauuuacauacaauaucauacaucuaagaugaaacugcauguuaaaaaagugaacaauuaaaaaaagucacagaaaucacucuauuuuaaauuuggaaucacaugaacauuuuuuauaaaugugugcuguggccaggcgcaguagcucccaacuuuauaaaccagcaauuugggaggcugaggaggggacugcuggaacccaggaguucaugaccaacccaggcaauauggcaaaacgccaucucuacaaaaaauacaaaaauuagccaggcaugguggcacauaccuaugaucccagcuacucgagaggcugagaugggaggauagcuuaagcccgggaagucaagccugaagugagacaagauugugccacugcacucuagacugggcaacagagagagacccugucacaggggaaauaaaaaaggggguggggggcugcugcauauugcuggaacacauccgaagggccuuagaggggccuuuguguuuuauaaucugucucacuugaucagagaaaaauauggaaauuugugcaaugagaaaauauccuagugugaauacagacaggcauuucauugaaacuauacaauuauuuacaacuaacuugacaaucccaaaugaaaacugucuacuacacaacagaaaaccauuaaaacagugcuaacaucaauagaguuccuuuuauaaaaagaaaacuaaauugaaguuaccagcagauuacuuuuacuuuccacuugguuuuuccuuuugguuauauuacugacaggcaccaaaguagcuacagagaaacauacaugcagaaauccaauugccaagaaaucuuuugcaucugaaucacuugggacucugugugccugaucauacuacaaacuucugaaguuauucuacaagccucaaaaugcuaaucagacuuuguuacacacgcuugugucuucuaaaacuaaauuggugauuucaaguugguaugcauuugcuaaaacauaaaaaucuucuuaagcucccauauuuauuuguaacaaauauauucuuacugucugugauaugguuuggcugugucuccacccaaaucucaucuugaauuguaguuuccauaauccccacauguugugggugggacccgacccggugggaaguaacugaauuaugggggcaguuacccccaugcugcuguuauugugauagugaguucucacgagaucuaaugguuuuauaaggggcuuuucccccuuuugcucaguacuucuccuugaugacaccaugugaagaaggacauguuugcuuccccuuccgccaugauuguaaguuuccugaggccuccccagcccugcggaacuaugagucaauuaagccucuuuccuuuauaagugaccccaucucggguuugucuuuguuagcaucaugagaaugaacuaauacagucugcuaaagguuaaaaaaaaauaaaaaaauuaaaaaagcaacugauuucuuaaagugaagaggaaaguaaagaaaauuuaucucauacuaagugacuuuacuuggccuuuuuuuucaaaucacuaugauagagacuaaaauugggucacugguaaauucacuugaacaaccacuaggcuaagcaaaacagcuguaguaccccuuagaccaacuacacaucacuuaaacuugaggaaggggagaagagggcguguuuauauuagguauucuuggguauauuuguauauaaccagauaacuagagugcauauguaugugugugugcacaugcgugcauguguguauguauuuaucucagaucaaguuaguucaaaguaagggcagaaaugcuguuuccuuuuucaacagguaacauauuuacagaauccaagagguuuuaguuucgagagagcauuucuaaagaaacagcacuaucauacacucuguccacccaaaauucacuaaaagacuaacauacaaaagguugagaauacaaaguuuacacugaaaugcacucaaccaugauugugaaguuuuuacuaccuuuaacucccaucacccuaguaaacagauaacgaagggaagaaaaaaaaccacaccucuccaagaaauguuaugcacugaucaaauguugaaagagaggaggaaaagggagggaaggcuagcacaauaccuacuagcaggaggcuaguauuaguaccuacagcacauuuucaaucucuuguaucuguguucuuuaaauccucaaaacaguaucaauucuuauaguuggguuuuucuuagaacuucaacaauuauaguaucauaccauucagcacaugaagauaagaaaucacuacgucugaagguuaaaaguaaacuuuagucuaacauugucucuuauuuaguucaucuccaacaaacuaugugccaagcauugugcuacaugguagaauauaacaguaaauacgacagaacaccaugacaggaaaguuuagguucuaguggagaagacagacaaauuaagcaacuguaaucugguauaguaaguaggaggauacacagggauacaaaaaaauaccugucucagucuuagaauuuuagcauacauuuccugaaagaacugauggcuaaacugagaccuaaaagaugaauggcaacugacuuggaaaaagugagggacugagaaggaaagugagaaaaauauaacaggcagugggaaaaagcacaggcaaaaaaaaaaagaauugacuuaucaaaagauauauagccauaacaauacccuaaacauucuuuacaauauacuuuacaaaucuaauucccaccaaauaaaauggaaagaauauaagcuuauaugcagacauguuaccuuacuugcugaauacagacauacuaccuuacuuauggaauuucuuucaguuccucaaacugaaauaugccucaaagaacauuuuaaaaguucaaaauauucucagaucuguccuuucaucugguaucagcaauaacccuaugagcacagggcaggggaacaggcauuauccacucucucccucaaaaguucuccacaauaugcccauuuuucuacuauacauaggcuuauaucccaaacaaguuacaauuauucauucaacaaagauuuuuuuaagcuccuauuaugcguuaggcaauguuuuaaggcauuaguuuucucccucuaugcuuucucaaaguguuucuccuauuuaacuuuuuuaaaaaaauaagggugaaauauuacacaauuuacucaaaagucauccuaaaacuaaggcauuuucuacgugccuuuuccucagaauuuuccauuucuguauuuauucacagucauggaaauaucaguuauccaucagcucaaauuauaaccucuaugagagcaauccccaaauuucccucucuaaaucuaacuuccuuccuaaacgccaggcuuaaauuaacaaagcucucccaagaaucuucaccuuaaggugaauauaucaacaucuuaaaaaauuagcaaauaucuccacaaacacacagacacucucacacuucucuuccucuuuauuaauaacaccagcauccuuccuaguguccagaccuggaauuucaaaagcaacuuugauuccuucuugugguguuauuuuauuuauguaugugguuguguuuauauaucuauauuuuuaaaaauagguuuucguccacaguuccuggcuuauaacucccauagcccuuuguguuagucugucuugagacuggguaauugguaaagaaaagugguuuauugcggcucaugguucugcaggacuauagaggaagcauggugcuggaaucugcuuucagugaggccucaggaagcuuuuacucauggcagaaggcaaagggagagcuagcacaucacaugaccagagagagcaagagaaggggggaggagccaggcuccuuuaaaccaguaguccccaaccuccggcaccagggacugacugauuuaguggaagacaauuuuuccacagacaaggggucagggaagaugauuucaggaugaaacuguuucagcucagaucaucaaccauuagauucucauaaggagcacacaaccuauaucccucacgugaggaguucacaauaggguuugcgcuccugugaaaaucuaaugcugcugcugaucuaagcucugcugaucagaagguggagcucagacaguaaugcucgcuugccuguggcucacaccuccugcuguguggcccagcuccuaacaggccauagacagguaccgguccauggaguagggguugaggaccccugcuuuaaacaaccagcucucacuugaacucauuaccacaggggagggcagcaaaccauucaugagggauccaccuuuaugauccaaacacccaccagaccccacuuccaacaauggaggucucauuaaauacgagauuuggaggggacacacauucaagcuauaucacccuuguuauagucuuuuauuacaauguuugguguguuaggccucaggaaacaauaucccugaccuucuccugcccuccuuucaucugcaccaaggcaggacucuaauuuuccuccacuuuucugacugugggucauaaugcccucauuucagagaggguccuauggggggucuucccauuggggaaagugcugaugucaugaaaauuccauaaaaaaccaaaaggacuggccucacagcugaacaugugaaggugggcaagaaggugagcaagaacucauccacuugcugggagaguggcauacccuaacuccacggaaacagaggcuccuacauuugggacccuuccagaccuugcccuauggcauccagaccuugccauauggcuguuuacuuguauccuuuaacauauccuucauaauaaaccaguaaacguguuucucugaguucugugaguaacucuagcaaauuaauccaacccaaagaggggguuguggaaaccccaacucgaagccaucugguagaaguuccagagaugcagacuuacaaccagugggaaggagggcccagaccccaagacugagcccucagccguugggaaucugacacuaucucuagguagugacagaaaugaauugaaagccaauuagcugguguucacuguagaacugauugcuuauuuggcagggagaaauacugugcauuuggacacagaaguccucuguguugauuguugugguguaagagcagaggaaaaacaauuugggaguuuuuccuaaacacuucuuaucuuccuagacauaaaacuacugccaacuuguauacugcaccuccaguaucauugaaauuauucucguuuuccauuccuucauucauuacuacccucuccauaucauacuguuccaacccuuccuacaacuagggaaagauuuaucucccuaauaggcucuuucuuccuaaaccacaggcuuaaucauuucacucuaauagcucagaaguguacaaauugcuauucaauaacaaauaaagcacaaacuauucaccauggcauucaaaagccaccaugaaaggcuccagccucccuucuagccaaaucagacuauguguaacucuacaaauacuaccuuguuuucaccuugucuuuucacaaugcagucaucauucaauuuuugcuugucaaaacacuauguugaguuacagggaaaaguauacuugcauaaagccauuuuuaauccccuuuaacugaauacauuaccucccucugauaugguugcucuguaucccuacccaaaucucauguugaacuguuacucccaguguugggggagggaccuggugguaggugauugaaucaugaaggcaaauuuccccuugcuguucucgugauaguaaauucccgcaagaucugaugguuuaaaaguguguggcgcuuccccacuuuacucucucugucuccugucaccaugugaagauguucuugcuuccccuuugccuucugccaugauuguaagucuucugaggccucuccagccaugacuccuguacagccuacagaacugugagucaauuaaaccuuuucuucauaaauuacccagucucagguaguucuuuguagcaguaugagaacaagguaauacagaaaacugguaccagagaaguguggcacugcuauaaagauaccucaaaaugcagaagcaacuuuggaacuggguaauaggcagaggcuggaacaguuuggagagaucagaagaagacagaagaugugggaaaguuucagacuuccuagagacuugcucaauaauuguaaccaaaaugcugacagugauauggacagugaaaauccaggcugauguggucucagauggagaugaggaacuuauugggaaccagaguaacggucacucuugcuaugauuuagcagagacuggcagcauugugccccugcccuagagauguauggaacuuugaacuugagagaugauuuaggguaccuggcagaagaaauuucuaagcagcaaagcauucaagaugugaccugguauuuuucuaaaaguauaugcucauauguaugaagagacggugugaaauuggaacuuauguuuaaaagggaagcagaacauaaaaguuuggaaauuuugcagccucaccaugcuauagaaaagacaaacccauuuuggggggagaaauucaagccagugguagaaauuuacauaaauaacaagaagccaaaugcuaauagccaagacaauggggaaaaugucucccagggcaugucagagaucuucauggcugccccuccaguacaggccuggaggucuaagagggaaaaaugguuucaugggccagucccagagcccugcugcuaacugcauccuugggacuuggugccccgcaucccagccacuccagcuccagcuguggcuguggcuaaaaggggccaauguacaacucgggccauggcuucagagggugcaagccacaagccuugguggauuccacaugguguugggucugugggugcacaaaaggcaagagaagagguuugggagccuccaccuugauuucagaggauguauggaaaugccuggauguccaggcaggacuccgcuacagggccagaguccucauggagacccucuacuagggcagugcagagggggaaaugugggacuggaacccucacagagagucuccacuagggcacugccuaauggagcugugggaagagggccaucauccuccagaccccacaaggguagauccacugacagcuugcacugugugccugcaaaaguugcaggcacucaaugccagcccauuaaagcagcugugggggcuguauccugcagagccauggggcagagcugccaaaggccuuaggaggccaccccuugcaucagcgugcccuggaugugagacauggaaucaaaggauaugggagcuugaagauuucaugacuucccuguuggguuucagacuugcauggggccuguagcccauuuguuuuggcuauuucucccauuugcaacaggaacauuuacccauucccuguacucucauuguaccuuggaagaaacuaacuuguuuuuuauuuuacaggcucauagguggaauggacuugccuugucucagauaagacuuuggacuuuucaguuaaugcuggaaggaguuaagacuuugggggacuguugggaaggcaugauugugucuugacaugugagaauaauaugagauuugggagaggcuggggagaaugauaugguuuggcucuguacccccauccaaaucucauguugaauuguaauucccaguguugggaggggaccugguaggaggugauuggaucaugggagcaaauuuccccuugcugcucucgugauagugaguucucacaagaucugaugguuuaaaaguguguggcacauuccccuucacaugcuguuucuccugucacuaugugaagaugugcuugcuuccccuuugccuucuaccaugacuguaagauuccugaggccucccccgccaugcuuccuguacagccugcagaacugagucaauuaaacauugcuucuuuauaaacuacccagucucagguaguuauuuauagcagugugaagacaaacuaauacacccuccuuuaaaauccucugcauuuagauaucaaucuuccucuaucucauuguacuuuuuuacauguuccccuauacuggccauaaacuccuccucuaacaggccaaauuuugcugauuuuuauauacccuauagcauucuuaguacagugcuuugcauacaguagggaauccacaaauauuuguggggguuauaauagaagcucagguagaacuguucucuggauuucuauaugauauaugaaagcacgcuucaaaaugccaagaacauuuuagcccagcaaugaaucucaaccuaaugguaguaccauuacucuaaauauccuuuagaaaacuguuucauuacaacuaucuauuauaaaggggggauauuugaaaaggcaaagcucuaaaaaaaaugggaaaaaaugagcuuaagagugugagaaaaacggcugggcgcgguggcucaagccuguaauuauagaaauuugggaugcugaggugggcggauugcuugagcucaugaguucaagaccagccugggcaacauggcaaaacccugucucuacaaaauguacaaaaauuagcugaguguggugguaugcgccuguaaucacagcuacucaggaggcugaggcaugagaauuaauugaacccagguggccgaggcugcagugagcugagaucgugccacugcacuucagccugggcaacagagcaagauucugucucaaaagaaaaaaaaaaaaaagagcaugagaaaaacagucuuauuagggaaaaaggucaucuuuuccuuaaaaacagaagagacaaaagauagguggaaacacaaugucuacaaucauagaauggcaaaagaacaaauacacaguugccucacaguaaaaaguagagaaaauuauuuuaagaugaaauaucuaggauggaaaaagcuuucagauaucuagucuaauuccuuaaggucacaaauaagcaaagugaugagugaacuugaaaauauguaauuuugauucucccuauaaaguaguaaucgaggccaucuaaugaggaagaagauaggccuuaagcagugugguaaaauggcaaagcagagcagcuaaggggaauuuauuaaaagucuggaacgcacaaacaaaaggacugcaauaagagcaccauguaauaaaaguacagaugaaguuaccacaaauuugugguauccgccaggcgcaguggcucacaccuguaaucccagcacuuugggagguuaaggcgggcagaucacaugaggccgggaacuuaagaacagccuggccaacaagguaaaaccccaacucuacuaaaaauacaaaaauuagcuggguguaguggcacacgccuguaaucccagcuacucgggagucugaggcaugagaacugcuugaauccaggagguagagguugcaguaagccgagauuucgccacugcacucuggccugggcaacagagcaagacucuuucuccaaaaaaaaaaaaaaugugguauccaaguagcagagucaggugacuuuucccauaaacucagauucuuggcacuuuagagccgcuuuaauuuccaaagcucuuuuucucacaugcaagaagaaaucagugaguccacaaguuaccagaaaacagcuuuguaucuauaauugugagaggcuuugacaguuuaugugcaggaaguucccccaaaacagggaugcugaggcacaggguauuaaaaacagauacaggaaggaccaugcaacuuccuuacucccacucuccauguucucaauccucaagucucugugggacaggucuagaaauuucagagaagaaagauauuuagauaguggcaauccugacacaugaaauaaaaugccaugaaauuugagggagagagguagaaaauuuaaggaugagaaaaaugaagaagaaccuuugguugugaaguauuuuugugauuguccauuuaacuguuuaucuacugauaaccugggaaucggaauaagcuauccauuacugucuuuugaaaagcuaauuauuuuuuccgcagcuauuuuucccauuuuuuaaaaugcauucugaaaccaacuggcccucaauaagauaacuauaguaaccaggcaaagaaggaauuaucuuccagguaccauagcaagaacaucuuagagggcacaucuauuacaggcaacagaagccaaggcacaagcuaaccauucgucauauuugcuuuaaauuuauacuuguaauuugcuuuuucaaacaaacagaucuggucucagagcauucuagcacaaaaaaguuaaacauuaauaguucugaaaauuauccaaaaaugugaguuuaaaauguauuauuugguauacagauuuuaacauaguguccauaauuuuuuuaauuuuaaggaaauuacuaauaaauugaauuacaaauuacugaagaaaccacagaaaaauuuuuauugcaauuccaaaugacuuucaauaauuagaaaaaagaaucagccuauauauccauuuuuugaaauuaaacuuuuuaaaccugcaguguacuuuaaaucaacauuguuuuugaaguaaaacaaauaaccauaauuccuaggaaguauuuaaucugcuugauuacuaauauacaaaaauaauggaagcagacuauuauucgcaaggugcuacuuauuuaauagcacauaaaauaaucuugacagcaguuguucaacccucucccauauuaaacauucuaauaugagauuauuaaauaguauucuauauuuacucuagguugagagggucucugaaaaacccaaaagauagcacacuucuuuaaaaacacaagauuuuuuuaaaaggaagcugcuaugauuugaaugugcccccaaauuuccuuuguuagaaacuuaauccccaaauucauacauugacaguauuuggugguagggccuuugugaggccuaccuuugugaggauuagauagggucaucaggguggggcaggcccccaugaugggauuggugguuuuuauaagagaaggagagaccugagcuggcauucuccugcccucuuaccaugugacuaccugcacuuuguuauuauguagcuagaaggcccuugcuagaugccaaccccccugcccagucuuggacuucccagcauccaaaauuguaagaaauaguuuuuuaaaauaaauuaccaguuucagauauucugcugcaguaauagaaaauggacuaagacugaaguuuuugccuguuagccauuaauagaagcuguguuguaauucuguacuucuuuaugaacauagugaauaugacaaucagaauaauauauccauuuuaauauaaaacucuuuauacuuuacauaauuuggaaaccacauucugccuagcucccaaauauaaugcccucaaaaagguguaauauucaaaaauguuuuauuuaggaucucugaaacaaacuuaaagaugggggugucacuuaucuaauaaucuaggucacauaucugucauacucauccaguaucacaauaaagaacauuuaacaauguaaauaauuccuaacucucccaucaaccuuaaagacagaauugcauuuccaccagcaacuggaucuuucaaucuggauaucucaacuaacaacuaaaacucaacacuuuuuuuuuuuaaaugaccaucaucauucgucccacagccuuucucuuuaccucuccucucucuccuguuucucaucuuuacuugccauuaacaucaauccagauacccaagcuaugagcugaaccaucuauugcugguuuuuuuaagaccaaaaaauuaaauacaauucaaccugauggaaacuucucaucaguaucucugaccuauuucucuaccuguuucccucauauccaaucagucaaaaagccuuaacaauuccaccuuccuaugcucucuucuuccauccugucauuuccuuucccacccauuauguucucuauuccuacaacagauuuuucaguuuuacuggucuuccaucucuuuauacaucuauaauauuaucuccagaaacaacuaugcccaaaacacaaaucaaaacugaaaaagucccauugcuuacagaauuaaaucuaaacaacugguacagcauucaguaaucuuuauggcuuggccagucuccacuggacuaccugucauuucuuaaacaaaccaaacaugcacuuucuuuauuuuuuuauuuuuuauuuuuuaucuuuuugagacagaguuuugcucuuguugcccaggcuggagugcaauggcaugaucuugacucaccgcaaccuccacgucccggguucaagcgauucuccugccugccucagccucccgaauagcugggauuacaggcaugugccaccacgccuggcucauuuuuuguauuuuuaguagagacaggguuucuccauguuggucaggguagucucaaacuccugaccucaggugauccgcccaccucagccucccaaagugcugggauugcaggcaugagccaccacgcccggcccaaacaugcauuuucagaccucuuugaucacacuacuccuuuaauuugcaauguccuuauugccaucccuuugucuacagaaaucucucucauucuucagugucuaccuuaaaugucaucucguugaucccuuggucauaauuaaucgucuaccaugaugucagcugauuucuuagacuuuuuuuggcauuuuaucuuaucuguaauauaaucaaucauuuucauaucuguuuucuccauuaaaguaaaaaguuacuuguggauacugggggacauuuaagucaucuucacaauucucuagucuagcacauggcacaaugccuugaacacaguagacacuggcaggugggagaugaggaaaacaaaucugucaaaaaguccugccuauguggaaauucaaaagucauaaucgcuuacugaaauccacguaucuagccaaacuggagaaugacuuucacucucccauucaagcuauuucucaccucuccuuccucuuuuucuugguaaagcccggcuuccaaacuauuugcauuguccuccuacccugugguaguuaucuaucacucuucccuucaaggaauaccuauaccuccagggagagccaaaauucagccaccucaaagauauuagauuagcuaaagaccaccugugcccaaagugauauuuuaaaccuaaacucacccaguauaaaaugccauuugaucacaucaaaaacugagauagaaaugugaguuuccucacuuaaacacccuaaccuccccuacucugaacucccauaauaucugcaguccauacaacuuguugacacucaaagaugauuuguaagacgccuguucagcccccauccaauucagggaaaacacucacagucucucugugggaacucuuucucccucaauuccaacagggaaaguaucauuuuccuucaauaaucuggccuacucauaguugaucauucccugauaaacaccugaaccaaguauucaaguauuuuuuucacacucauacuaacaaaucuguuuuuuucucugauagcgaaagauuuaggaugcaagaucaaagaaagaguucuuguuuauuuguuugcuagauuuuccaguacucugaggagccuguguauaagaagaaagaaugaagcugagaggaccaaacagaugaagagauggaaaugaagauucaugguagcauucacauccccaguuccagauaucccugagauuccaguugcaaacuaucuuucccuuaguuuaguuguucaucucauccuucgauaaccucuagcccagaaagaggagacccagcgaaaaggucucuaggcccguucagauguuuaaaaaauugcuggccccuaaagaacuucuguuucuguagguuauagcugucaauauuuacuguauuagaaauuagaacucagaaaaucuuaaauguuuagaaauuaauuuaaaaauuacacauaauggaguaacuguuaauacagauaacauauucuucacguaaaauauauucuccaaaaaaaauuuaugagaagagcagcaccaauuuacauuuuuguacaaauguuuacuaucuaacuuaacagaagacagauuuccuuaucuguuucugcauucaauauguugcucuauauugcuuugauucauaguauaugaagacuauuacuuacuaaaguuacauauaaguuaaaugaaauguagaaucugaccacauguauaauaacauuuguauucuauuccauuaaaauccacuggucuaucauuuacugaugcauaucauagguugcaucaugcagugaucaucugaaaaauacugcuucacugagcuaugcagaucuuccagauauuaacacauuucauuuacauuaucaaaacauuacauuccuuauauaucaccaguaugcaguaaaggauuaauaacccaguagggcuagguuguccacaccuuggauauuccaaaggaagguuuggcccuugcccacccaaggcccuugaaauauccugcuuaauaagagugccuuuguuuacugaaagccuucagccacaccauacagauuaugcuaacaauguaauuuacgggaggggccuugguccaugcaguaucagucugaccucuggagucaaacagauggaguuacuaaagucagcgacgugggcacuuuagaccuucaugaaagauacccaaaagaucccuggacaccaagacucaggugaguucuccugguuggcaauacuugacacguguugucacauacugcugcugugagcggcaguuaagcacugucucuaugacuccccugggagagggcaacuggaagcuugcaucuaaucucugcuggacucugcccuaugcaccuuuuucaauugcugauuuuaaacuguagccuuuugcuauaauaaacuauuauuacugugaguauaacaguuuugccauguucuguuaguccuucuagaaaaucacugaaccugagguuggucucagagacuucugacaaccaucaaucucaucagaaaagucauuaaguauuugggaaacccucaaagucacaguuguagauacaaagccuccaaaauucuaauuuuugcuugaaaauuuaaauaucgccugaaagcaccagauacugccaguuuuuuuccuugaagugacaggcucacuuuguucuuuuucaagaaaaugucugccauauacugaaaucuaaauaaccauaguuugucagcuauuuuucaaaguaaaacuaaugugucauaaaagaaguggcuaguucagauaucgacucaauaaucgcauaacuauuuuuucucaagacauugcacgucagaauauaguauuauguguucuuuccauuucaacccacaaaauacuaaaaggacauauacucaaggacugcaacuuaauaaaauuaauaauuuuuacuguucuaucaaagacauucuuaacuggaacuggcuuuauuuuuuucugcagcuauguggcagcaaagaauacaacaauuacuaguauaguuugaugcauaaauuacuugauaaugaaucauuugguacauuaaugcaauuacuacauuaauuuauacuaaggcaucagaaguuuuugcuuuguaccauagugcaaaugucaagaaacugaaaauggcaaauaauacauuaguauuaugaaaauuauuugacuuuacagacuucuugaaagggccucagggaaccccaugguuuggaacucuagugaaagcagacuagaagagacuaucaauaccaggaaagccauuccaaccacuuucuugaacaaucuuaacuaagucugucagcgcuuacaugaaaaacaagaccaucacgaauauuguaacaaaauuuuaauuccuuccuacuucuuuaugcaaagccuacucagacuccauuaguuguaaauuuuugguggccauuguuuucaaguaagauaacucgauugcaaaaaauaacucaggaaauaaguuauuucuaaauaauuucuuaauucaacucucauauucuauugacauauuucagauuuaacuuacuagcuuugcaucuuuccuuugcuugcaaauauuuugaugauaaauucuagucucuuuugauuaguaauuuuucuuuagaugaaucacacaucuauggaauucuuuuuuaaaauuccuuauuuucuucuugauaguuugcuaugauccucaucuuuaacacaauuucagaaauuuaggaaugucuuacauauaacuuaaaguuauucacaaagaaaucaaccucaaagcagucaauugauuuucaaaagcaacaaacugcuugacauuacuugccccaaccaacaacagaagucuuuccuguagucaaaacauuauauuaccucucuuucuucuuuuuccugguaaagcccugccuccaagucacccaacaaguagaagagcuuucaacuagcacauaaacauaaauccuaaaaaaggaucuuaucacauauaaaaauuuaauguauaauagaaagcauaucacaaaaaauauucaacaaauacugauacaacauucaguaagaugcuuggaaaguuaucaacuuagaaucccaaaccaugccaaauuaaauguuaaacaaguuaaaguauuuuuuuaauacuauaaaaacuauagguuuauauauaaaauacugauauaugauaaucuuugcuuaaaagccaaaacaaaaaccaaaaaucaaagaaauauacaaagacugagauuugacaguacaaaauauaugaaagcaggcaaaauacaagaugugcaugugcucacauaacacaagaaaggaucaucacuguggcuguuuacaguaucauaagacuagauaaaacuuaaucacuaaagaguaaauaaauuauguacauccaauagaaaacuaugugguuacuuaaaagagcaaggcaguuuaaacauucagaaguacacaaacacacuguguguauuaccauauacuuaucuucaagucuuugcacaaaaaugucacucaaugaguccuauacugacuacccuauuuaaaauggcaacuucuccucuccagugcccuacuauccugucugauugcucuuuucuuuuugccauagcacuuacuaccuucuagaauucuauacuauuuauguauguaucauauuuauuguaugucuccucucugcaaaauauaaccuacagagcaacagucaucuuaaucuguuuauucauguauccuaaccaccuaaaauagugccugggauaagacagguucuaaaaaugucaucccuuaaauaaaccaauauauacagaauugguauugacccuagaaagucuaacugggaaacugagagccaguggcagaaagggaucuuuuuaauuaaagaguaccuuuuuuaauauguuguauuuuuccccucugugaaaauauacauugccuauuagaaaacuuaaucuuaugcauugcuuaacgacagggauacauucuaagaaauuuaucuucaggcaauuucaucauugugcagacaucauaaaguauacauacacaaaucuaacugccauggccuacuacacaugguauagcauauuguuucuaggcuaccaaccuguacagcauauugcuauacugaauacuauaggcaauuuucacacagugguauuuguguaucuaaacauaucuaaauacagaaaagacacaauaaaaauauggcauuauaauccuauaggacugaccaaaaugucauuaugcuaacauuacuguauguuacacauagguaaacguauacuuauguguuauacaaaugcauguacauuauacauauauauacacaacagcaaugguuacuaccaagaacagugagauuauggagguaugagggaguaaagacuuuuuccuauauuguucauuauuuuguuuuuuaauaauaguuauaauacuugucacauuacuugcagcagaauaaucuccaaucaagaacugcuagaaaagacaaauaaaacacaaaaaauaaaaaauaaaaagaucagucuguuuaaaucauccaagagcucaauauggaggcaaucagaacuuaaggaaccaacauuucaaaacaaauagaauccuaaagaaggugccauucagcagccacucugccacuuuuucucucaaacuauuuauuugcauauuguggucacaaagcaagaggcugagaauucaugcaaaagacccaggucuucugucugggucuuuugcaugaauucucaggaggaaaacaauccagcagaacuuucaacagucucacaaagcuggugagacaaauauuaagagacuugaagggccaggauucuggucauaaaaaagaaacagagaacugaaccacaggcuuaacuauuucccuccagcgauaucuacugaauugugaagcuacacagauaagaagcuaaggaaagacugcauagcaaacugcaguauucaaaaguuuugugauuaaggugaucuaacugcauucuaucugccuaacacaggaguggcuaagccguccauccucuacagcaaaugaucauucagauaaccuauaaaauugucaaacacaaugucuggcauuuaauuaaaauguaacgcacgccgagagaguauacaagaagacaaacaaguaaaucaaugaaacaaagauauaaaacuucaggaaaaaaacaaaaguugguucuuggagagacuauuaaagucaacauuuuguuaagacugaucaaagaagaaaaagucacaaauuaucaaugucagacccaaaggggaauaaauuuuaaaauuacagacagaaggcuauaacaguuauucaagaaaauacaggaaaacacaaaauaaagauggaauuuaaugauaaaauuugaauauuuaaaaaguaaucaaauuuguaaaauuaagagcuaaauauaauauuaacagcagauuaggcaguuuuguguuguuguuguuguuguuguuguuguuguuuugagacagaguuucgcucuguugcccaggcuggagugcaguggcacgaucucggcucacugcaagcuccgccucccggguugacgccauucuccugccucagauuaggcauauuuuuaagaagcuaauaauuugcaaaguuucauagaaaauacacuuacuagagcauaaaaagaaaacaaggacagaaaauacagaaaaguuauaccugucaaaccguaaugcagaaaaaaagaaaauacagaaaagaauacaaaagaugaaugggacaucguuuuuuaaaaaaugacuaacgggcugggcaaaguggcucacaccuguuaucccaacacuucaggaggcugacgagggaggauccuugaagccaggaguucaauaccagccuggacaacaaagcaagacccccaacucuacaaaaaagguuuucuaaaacaaauacgcugcacacaguggcgcacaccuauaguccccagcuacucaggaggcugaggcaagaggacugcuugagcccaggaguucaaguaugcaguaagcuaugaucguaccauugcacuccagucugggugacagagugagacccugucucaaaaaaaggggagguggcggaggguacgcagacauacauguacaguacgagaaaggaggcaauagagaauagaacaaaagcaaaguaugaagaaaaaauggucaagaaucuuccaaacucaaugaaaaauguuaaggcaaagauucaagcauucuauauaccccagcaagauuuuucuuuuuuucuuaaaaaaaaggccacaucuaggcauaucauaguaaaaaugcuaaaaaccaaaggcaagacugaauuuuuuuuuucaacuuuuaaguucagggguacaugugcaggauuguuacauaaguaaaugugugucaugggagucuauuguacagaucauuucaucacccagguauuaagccugguaccuauuagucauuuuuccugguccucucccuccuaccacccuccacccucaauuaggccccaguguguguuguuccccucuauguguucagaucauucagcucccacuuauaagugagagcaugcaguauuugacuuuucucuuccugcauuaguuugcugaggauaauggcuuccaccuucauccauguccccgcaaaggacauaaucuuguucuuuuuaauggcugcauaguauuccaugguauauauguaccacauuuucuuuauccagucuauuauugacaggcauuuagacugauuccaugucucugcuaccgugaagagugcugcaaugaacauacaugugcaugugucuuuauaauagagugauuuauauuccuuugguuauauacccacuaaugagauuuauggguugaaugguauuucuaucuuuagaucuuugaggaauuuccacacagucuuccacaacaguugaacuaauuuacacucccaccaacugcguauaagcauuccuuuuucuccacaaccucgccagcaucugugauuuucugacuucuuaauaacacccaugcugacuggugucauuguggcuuugauuuacaucucucuaaugaucagugauguugagcuuuauuucaucugauucuugcccgcaaguacgucuucuuuugaaacaugucucuucauguccuuugcccacauuuuaauggauucuuuuccucguaaauguguuuuaaguucuucuagaugcuggauauuagaccucugucagauauguaguuugcaaaaauuuucucccauucuguggguugucuguuuacucuguugauaguuacuuuugcugugcagaagcucuuucauuuaacuggaucccauuugccaauuuuugcuuuuguugcaauugcuuuugccaucuuccucaugaaacuuugcccaggccuauguccugaaugguacugccuauguugucuuccaggguuuuuauaguaugggguguuauauuuuaguuuuauuucaucuuaauuuuugcauaugguguaaggaaagggucuaguuucaaucaaccugcauauggcuagccaguuaucccagcaccauuuaauaguccuuuccccauugcuuguuuuugucaaguuugucaaaaaucagauaguuguaggugugaggucuuauuuccagguucucuauuccguuccaucgguguaugucucuguucuuguaccaguaccauguuauuuugguuacaggagcucugugguauagcuugaaguuggguagcaugaugccuccaguuucguucuuuggcaaaacuaaaucuuaaaaguagucaaaacagaaagacauuauauucaaagaaacagauaaaaaauuuuugcuaacuuugcaacaaaaauacuggaaagcagagagaauggaauaucuucaaauuucugaaagaaaguaacugugaaucuagaaucuaaugcacagaaacaauauccuucaaaaacaaaaacaaguacauuuucagauaaauacaaaguauauuugacaacugacguuuaccaaaaaaaaaaaaaaaaaaaaaaaggacuaaaagaaguuacacaggccaaaaaaaaaaguuaaaaaguuccuaaccuacaggaaagaauggaaaugcagcauaaagugaagagcaucauaaagaguaaauacauguguaaacaaacauugacuguacaaagcaguaauaucuaaugaauauuaaaauguguacaauaggccggcacgauggcuaaugccuacaaucccagcacuuugggaggcagaugcggguggaucacuugaggucaggaguucaagaccagccuccccaacauggugaaaccucaucucuacuaaaaacacaaaaauuagcuggguaugggggcacacaccuguaaucccagccacuugggaggcugaggcaggagaacugcaugaacccaggagucggagguugcagugagccgagauuguagcacuguacuccggccugggcaacagagugagacuccaugucaaaaaaaaaaaaaaaguguauaauaaacaugcagagcaauaaugcaaaaagcagaaggauaagugaaguucagauguucuaaguuccuagaauuguuagggaaauaguaaaaguaaauauuuucaguagacuguaauaagucaaugauacauguuguaaucuuuaggacaaucacuaaaagacuaagaugucaggcuauaugaaacaauaaaacccacuuauaagagauguaucuuaaauguaagaauacagaaauguugaaaguagaagaauacaaaaugcuuuaccacacuagcacuaaucaaaagaaaacugaugucagacaaacuagauuuuaagacaagaaguaucagcugggcgcaguggcucaugccuguaaucccaaaacuuugggaggcugaggcaggaggaucaccagaggucaggaguuugacaccagcuauggucaacauggugaaacucugucucuacuaaaaauaccaaaauuagccagguguaguggugggcgccuguggucccagcuacuugggaggcugaggcaggagaaucacuugaacccaggaggugcaguuugcagugagccgagaucgcgccuccagcuugggcgacaagagcaaaacucugccucaaaaaaaaaaaaaaaaaagacaagaaguaucaaagauaacagacauuucguaauaauacaguaaucaauucauuagaaauugguguaugcauaucuagaauuaugaauuauauauaugaauuauauauauauaccuuucaagugaacauagaacauuaaucugaaaccauaugcugaaucaaaaagcgagccucauuucaaaugacugaauucauucagaguauguucucucaagggaacuaaaucaaaaaauuacuaaccccuagaaaaacuguaaaaguugacauuuauguggaaauaugucuucacaauaugcuagugaagaaaucaaaugcagacaggucauauaacaauuugugacacguagcugaaguuaugcuugaagggaaaucuguaaccuuaaaugcuuauauuaaaaaagaagacugagaagaauuauuuaaguaucuaccucaagaaauuagaaaagacaaaaaguuaaaccugaaaagacagaaaaaaaaaauaggacacaauuaaugaaaucaaaagcaaagguacaacguaagacuucaggaaaaaaaaugaaaaauuaguucuuggaaagauuaacaaaauugauagacuggaagaagacugaacaaaugaaaaaggucacaaaguaucaauuucacuagugaaaaagagacagguccuacugaagaacaauuagucgugcuauuauacauugagaauuaauguaaagauagacaaguagacuaaugggacagaagugagauguaacaaacucacacauguaugaaaaauaugagcucuuuacuugacggaaaugggucaacuagauauggacauuguuuuuaaaugaaucuugaccucuuccuugcuccauucacaaaaaucaauuccauauguacgucuaaaagaaaaagacaauaaagcaucuagaaaaaaacacaggcaaauacguucaucuccuucgagcaugcaaagauuucuuaaacaugacuccaaaaaccucaaccuguuuaugauucaauguuauuauauaaagcugaaaaagucagaaauaaucugggaugugagaaguuagaauucuguuuauucgggaagagguggugugcguauuaggcagaaagcaggcccaaaaagauaucuaggaugcugauaauauucugggguucuuuaaguauggauuacacagguacauccacuuguuaaaacucauugcguugaacacuuagaauacuaugcuuuaguauaguauacuauacuauacaguauaguauacuauaguauauagaauacuaugcuuuauguguguuacacuucgaccacaaagagagaaaaaacugauaaaauuaacuucuguuaaaaaaacaacagugcgaaauugaagauuucuauaagauauauacucaucaaaagacucauagccaagacagagaauaaccagaaauaaauacaaaaaaagaaaaaccaauagaaaacuggacagaagacuugaagacuugaacuauaaccucuucaugaaagagguuauagaaaugaccaaugaacauaugaaaaaauacacacuuccauuagucaucacaucaagaaaauaaaaauuaaaaccacaagagcuauuacaccaccaacccaccuacaucacuacaaugaaaaggguaaacaauacuaaauguucacaagaauguagagcaacugaaauucucacauguugcuacucagaauuuaaauggguacaaacacuuugcaaaacuauucagcaauaccuaccaagcuuauuauaugaacauccuaugacccagcaauucuaauccuagguguauaacauaaaugucuauacauguucauuaaaagucauuaucagaaaauucauagcaaugcuaucuguaauagucaaacuagacacacccuaaaugucauguccaucacuaguagaaaaggauaauacacuguugguauagucacaauguaacacaagcaauggagaugagugaaauagugucacaugcaacaacaugaauaaaucucauaaacauaacaaaguaacacacaaaagaauagauaguaaagguugaguaucccuaaucugaaaauugaaauccaaaaugcuccaaaaucugaaacuuugaggaccaccaugacacacaaaggaaaugcucauuggaauaucuggauuucagauuaaggaugcucaacugguauaaugcaaauaaagccccccaaaaauacgaaaucugaaacacuucugguccuaagcauuaagggaaacucaaccuguaugugauucaauuuuauuauauaaaacucaaaaagucagaaauaaucuaggauacaagaaguuagaauuuuguuuuucaggaagaggugguguguguauuaggcagaaaguaggcacaaaaagacaucuaagaugcugauaauauucugggguucuuuaaguauggauuacacagguacacccacuuguuaaaauucauugugcugaacacugaagauacuaugcuuuauauguguuauacuucaagaaaaaguauacccaagggaaaaaaaguaauucuaaauacagaaaaacucuauacuaaaacuuucauuucaacacuaaagggagcaugcuuuaaaauuaguaugugcauauauauuauauguaauuauacauauacauaaauaaaacauuagacagucaaaauuauaucuacacuaaacacuuuauaacaauguguuguccagcuguuacccucucccucaucuguuauauugucuuggacuuaaucucccuuaaccccccaauacugccaaauguuuguagaggccacaacagugguaacuugaaaauucacuuaugucccauucagcagccuaagacuaagugguugguacuaacagcugagucaaugggugacucacagccaggaccuaacccugccucaucuuuucugccuuuccgugacuaaugccucaugcccacuaaggucagagacaggacagaaauucaugcaucugccucuuuggcauauguaguuuuauaccucucaggauuuugucaccauuuuucauuuucucuguucguuaacuauguaaauuuuaaucauauaaucaucuuuuaaacuuuuucaauaacaaaaaaucugaauauuuucuuuucauauaaaaagcucuucuaauaguaugcauuauucuaaaacucauuuuaacauccuuacaacaaaauaauuaaauuguagauauuaccuuauaaauaauugcauaagauuucauccaaaacuuuauucuaucauguuucaacuauauuucugucauuaguaagcaggauaaacuuaccagcuagggaagcuuucuuguaauccaucuaacucuuuuuauuuuaauauuuuuuugagacagggucuuguuagguuguuaagggcggucucaaauuccuggccucaagcaguucucccaccucagccucccaaguagcuaggauuacacgcagaggccacccugcccagcuuaugagacauaucucgcuuggucauccaagcgagugagagugcaguggcaagaucagaacucacugcaagcucaaccacuugggcucacgugaacuuccuaccccagccucccaaguagcugggaccacaagugugcuaccaccaugcccugcuaaacuuuuuauuuuuauuuuuuguagagacagggucucccuauguugcucgguuuggucucuaacucccgggcucaugcaauccucucuccuuuggccccucaaagugcugggauuacaggcaugagccaacugcacccagcccuccgcuuaacucuuaauaagcaacacuaaauaucuauuauucuuguuuuauuggucaucccuucaccacauauuauaguguccaaaggaaaaaaauuauaagaaaauaguauaacuccuuagcacuguugccucuacauaauguuaacacaccauucccuugcauacugauuuauucuuucaacaucuauauagguuucugacuccuggaacaauucacaucaacaucacaccuaccaccagaaagcaggugucaaacguuccccuucuuuguaagaaccauauacaguacucacuucugcagcacauauacuaaaaauugggaugauaauagagaaaagaucaauaugaccccugcucaaggaugacaugcaaauuugugaagcauuccauauuuuuuaggcacucuuaccacacacacacacacacacacacacaaacgguuaacuaugggagaugcgggauauguuaauuuacuugacuguaguaauuacuucacuacauauaugcauaucaaaacauuauguuguguaccuuacauauagacaauaaaaaagaaaagagaaccauauacaaaccuuauauguaaguacuuuauuauagccuuuuugguaacuauaaaacaucugcaucacugugaauuagaaauggagaaauguuacuauauuuuacaaaaggaaacaaucaugaggaacuuaaauuaacuuuuccaauauagugauucacuaaaagcauuaaaaaccacaaacucagguuuuccaaaggcuaaacuuggguucuuccucuauacuacucccacugugaacaccagguagauagaaacuuaacuacuugcuauuacuauguuucucaaaacacgcccugcaaagaaugaucacuaagcauguaaguuuagaaaaagcagaguuaaacaagaaaguuuguuuaguauauuaaugacucauaggacuccuguauuuaugucuaagguugcaauuuuuugagggugaaaaaucagaccuuggcgaugaccuugagcaguaggauauaaagaacucccagaugcuuagcguuccauuaauggaacacuaggcauaaauaaguuaauguacauucuggauuuccaagagcacaggcccaaaaugcagaaguucucaaauuauuuaacugucaaaaagucacagaacgccaauuccuuuaacugaacaaugcagugcacaauuuaggaaguguuaugccaugcuuauaaaacagcugacacuuguuaacuggcuaguaauucgcucucuuuguucaaaacugcuuucuucugauacaaugucuaucucaauucucuagguuuugauuaaauacaucagcaaauauugaaaauaaagcaucauuuacuuucaaauacacuaggguaaaaacaaaaaauccaaccucaaugauugauuuauaaaauagcuaaauauuuacuauuaagaauaaaaaaacauuaucaaauauuaucuuuugcuauucugaaaaaacuacucccuuuaauuugcuauccccucuaacuacucauucucugaaaggauguagccuccgaauucccacaaaccaaucucuuuuuaaccccuuuaaaacuuguaaccuuuaaacaggcuuuaagcugcugccugucaguuuccuguuccuuccuguuucuucuucuuuuuuuuuuuuuuuuugagacagagucucgcucugucguccaggcuggagugcaguggcauguacgaucuaggcucacugcaagcuccgccucccuggcucacaccauucuccugccucagccucccgaguagcugggacuacaggcacccgccaccaugcccggcuaauuuuuuguauuuuuaguagagacaggguuucaccauguuagccaggauggucucgaucuccugaccucgugauccacccgccucggccucccaaagugcugggauuacaggugugagccaccgugcccagccuccuguuccuucuuuacauguaagaagauuaaaagucaccacuccauccuaacaaguaaaaagcuaagcaaacugaaaaaccaauagcuguaguuagauccuucagagaagugaggucacagggcaaaccacgguuccccaaaauugagagacagguaggcagauagagaaaaaucucaagucaucagagcagaaacccacaagcagaaacuuccuugggaaccagugccaggguaagaaagccucaacuauaaugacaaauugcuggagacucagugccaacaaaugacaauuaaaaacuccaggaggauccagucaugugaggcccugacacucuugugaauuuuaccuccaggagcucuacuaugcccuuacaguaaauaucagagaaaaaucccuuugugcuucugguagggggaaggaaaaaagaacaauuuugaaauacgccagagcaaucaguucuuaacaaggccugccuugaacagaaacuaauuuaccagagccuaaccuaccuguggguaaagaaguacuguaaacaacuccaguucacuucagccuuucacaagagggaagggaaauaccaaauuccaguccuuucuaaccauucugucccaccuaaaggugacagggauaagggugggggacugagaaacaaugguuauguucacaguccaggagcacagguucaccaaaaaacugggaccuaauacuagaacuacacaaugccucccuuauaacuacaucacuaaaggccuauuugcagcaguuccuuuuaccuaguacaucauguauaccuuucaauaaaaaauuacaagacauaauaaaaggcaaaaaacagcuugaagagacagagcaaguaucaaaaacagacaugucaggaauucuggaguuaccagacugggaauuuuuuaaaacuaugauuaauaugcuaggugcuuuaugaaaaagguagacaauaugcaaauacauagacaauguaagcagagaaacggaaauucuaagaaaggauaaaaagaaauguuagaaaucaaaagcaacauaacagaaaugaagaaugucuuuaauggcuucauuaguagacugaacauagcuaaggaaagcaucucugagcuuaagggucuaacaacagaaacuacuuccaaaacugaaaagcaaagaaaaaaaagagaggaaaaagaaagaguagaacauucaagaacuguaggaaacuaaaaaagguguaacuuaaauacacugguaacacaaggaaacaauaaugacuaagaauuuccaaguucauaucagacaccaaaccacagauccauaaaacucagauaacauuaagacugaggccccuaaaaaccuaaaaauaauuuuuaaaaaucuaagcauaucauauucaagcuucagaaaaucaaaagcaaagaaaaaaaucuugaaagaaaccagaggcaaaaaacaccuugccuacagaagaccagcuucuccuuagaaacaaugcaaacaggagaguagaaugaaauuaaacuaaaguguugagagaaaaaaaacaugaaccuaaaaauuuauaccaugugaaacuauccuucuagagugaaagaaacauaaagacauucucagacaaacaaaaauugaagacuuguguugccaguagaccugccuugcaagacacauuaaaauaauuucaugaaagaggauaaugauauaggucagaaacucaggaagaacaugagagaacaagugaaggcaaaauaaaaacuuuuauuuuucuuauuuuuaauucagcuaaaagguaacaguucaaaauaauagcaaugauguaucugcuugcguaugccuauguauaagugaaaugaaugacaagauagaaaaggacagaagcaaggaaacaggaauauuuuguuauuauaaaguacuuacacaacccaugaagcaauacaguacuauuugacaaugugcuuggaaaacuguaaauguauauugcaagcuccagggcaaacacuuaaguuaggaaaaaaaagaaaaaaaaaaaggcugguuguaguggcucacaccuguaaucccaacacuuugggaggccaaggcaggcagaucacucgaggucaggaauucaacaccagccuggccaacauggcaaaacuccaucucuacuaaaaacacaaaaauuagcugggcgugguggcgcacgccuguaaucccagcuaccccagaggcugaggcaggagaacugcuugaauauggaagguggagguugcugugagcagagaugguaacacugcauuccagccuggaugacagagcaagacuccaucucaaaaaaaaaaaaccaaaacuagaggacaggcgugguggcucaugccuauaaucccagcacuuugggaggccaaggugaguggauugcuuuagcccaggaauuugagaccggccugggcaacauggcaaaacccuaucucuacaaaaaaaagcacaaacaguaacuagccaggcaugguggugugcaucuaucguuccagcuacuuaagaggcugaggugggaggaucacuugagccagggagauggagcagugagacaacaucacgccacuguacuccagccugggugauacagugucucaaaaaaauaaauaaauaaauaaaauaaaauaaauauauauauauaacuggugugcucaaaaaugagagaaaaaugaaaucauauaaaauaauuaaaucacaaaagacagaaaaagugcauaacaaaaaguuacaaagaaacagggcaacaaauagaaaaucguaagaaauauggugaauauuaauuuaacuauaucaauaaccacuuuaaacaucaagucuaauauaccaguuaaaagacacugucaaaguagaccaaaaaacaagauccuacuauaugaacaagaaacucauuuuaaauauaaaaacacauacagauuaaaagcaaagggauggagaaagauacaccacgcuaacgcuaaucagaagaaagugggagcagcuauauuaauuucagacggagccaacuucagagcauggaaaguuaccagggauaaagagaggcauuaaguaaugauaaagggaucaauaccucaagaagacccaaugauccuuaauauauauaugccuaacaaugaagaguaaaaauaaaaaaaaaccagaacuucaagaggaaauacauaaaugcacuauuagaguugagauuucaacauggcucuaucaggaaugggcagauccagccagcaauaaaucaguaaagauauaguuuaacucagcagcacuuucaauuaacuggauauaacugacaucuauagacuacuucauccaacaacagcagacugcacauucucuccaagcucgaaugaaauauuuaccaacauagaccacauucuggguaauaacacaccuuaacaaauuuauaaguauagaaaucauauaaugucuacuaucagaccacagaauuaaacuagaaauaaauaacaaaacauaggaaaauuccaaaguacuucugaauaaacacauuaaucaaagagaaaugugaagagcaauuuuaaaauacuuuaaauuaaaaugaaaauacaauuuaacacuucugggaugcagcaaaagcagugcuuggaggaaaacuuauaguuugaaugcacauguaagaaagauaaaaaaucaguaaucagagcuucagcuaggagcacuggcacacacuuguagucccaguuaccugggaggugaaggcagaaaaauggauagaauccagaaguucuggacuguaguacauuaugcccaguaaaccuccacgauuaguuugguaucaacaccccugggaacaggacaccaccagguugccuaaggaggggugaaccacccagguuggaaacagagcaggucaaaacacagaucaguagugggauugcaccugggaauagccacugcacuccagcuugagccacauagugagacccugucucuuaaauaaaauuuguauauaauaauaauaaucuaaacuucaucauagaaagcaagaaagaaaagcaaauuaacuccaaaguaagcagauaaagagaaauauagaaauuacagcaaaaaucaauggaauugauaacaggaaaucaauagaguaaauuaacaaacccaaaaguaacuuuucugaaaaaaucaauaaaacugauaagccucuagccagacuuacaaaaaaagacagaagacaaauuacuaauaucagaacugaaagagaagaucuuuacuaaucgcuacugaccccaaagucauuaaaaagauaauaaacuaauauuguaaauaaaucuacgcccacaaauuugcaaagcuaaaugaaauggagcaacuacuuaaaaaacauaaucugccaaaacucacaguagaaaaaaaaaucuugaauagaccuacaucuauuaaaaaaauugaaucaauaacuaacuuucagaaacagagggaaccaaauccagauggguucacuggugaauucuaauaaacauauaaagaaaagaauaccaauucucuacagucucuuucagagacauagcaguuacuuccuaagucauucugugaggacaauacuaaccuaauaccaaaaccagacaaagacauuacaagaaaagaaaacuacagaccaaucucuuaugaacauagaugcgaacauccucaacaaaauauuagcaaauuaaauccaacaauguacuuacauaccaugaucaagcaguauuuaccaagacuggcucaacauuuuuaaaaaucaauguaaucaaucacgucagggugaagaaaaaucacaugaucauauuaauagaugcagaaaauccauuugacgguauccaauacccaaucaugacuaaaacgcugagcaaauuaggaauagaagggaacuuccucaacuugauaaaaaaaaaaaaucuaccaaaaaaucuacagcuaacaccauacuuaauggugagaaugucaaagcuuucccaccaagauggggaaaaaugcaaggacaccuccucuuaccacuguuuuucaaaaucauacucaaaguccuagcuaaugcaguaaaacagaaaaaggaaaaagguauacugauuggaaaagaagaaauaauacugucuuuguucucagaugacaggauugucuagguagaaaauucuaaagaacugacaaaaaaccucauggaacuaacaagcaagguugcagaauacaaggaaagccacuggcuuuccuguuuguacaaaagaaacuuaaaacacauuaccauuuacauuagcaaccaaaaaaugaaauacuuagguauaauucuaacaaaauauguacaggaucuauaaaagaaaaacuacaaaacuaugauggaagauaacaaagaacuaaauaaaugcagagauacuccaaguucaugaauaagacucaauaucaacaugucuguucuucccaacuugacguacagauuuggcacaauuccaaucaauaucccagcaauuauuuuguggauaucaacaaacggauucuaaaguuuuuauggagagguaaaagaccuagaauagccaacauaacauugaaagaaaaagucggagggauugacacuacuagacuuauuauaaugcuauaguaaccaagauagugugguauuucagaaaaggacaaauaaaucaauggaacggaacaggaaacccagaaacagacccaaauaaauauaaucaauugaucuuugaaaaaagagcaaagguauggaucaaagacagacuuuuuaacaaacagugcuggcacaacuagacauccacaugacaaaaaaaaaaaaaaaaagaauguaaacacucaccuuacagccuucacaaaauuuaacucaaaauggaucacagaccgaaauuaaaaugcaaaacuauaaaacuccuagacaauaacaaaaaagaaaaucuaaugaccuuggcuauggugaugccuucucagacacaaaagucacaauccaugaaagaaaaaacgaauaagcuggauuucauuaaaauuaaaaacuucugcucugcaaaaagcaacugucaagaaaaugaaaagacaaaccauagacugggagaaaaauauuuucaaaagacacaucugguaaaggacuguuauccaaaaauauacaaagaacucuucacaacaauaagaaaacaaaccugauuuuaaaaugggcaaaagaccugaacagacaucucaccaaagaagauauaaagauggcaaauaaacacaugaaaagauguucaauaucauaugcauuagaccauucuugcauggcuauaaagaaauaccugagccuggguaauuuauaagugguuuaacuggcucaugguucugcaggcuguguaggaagcauggugucagcaucugcucagcuucuggguaggcucagggagcuuuuacucaugguggaaggcaaagcgggaacaaacauaucacaugauguuuggugaaagcagagcaagagugaguagcgggcaaggugccacacuuuacaacaaccagaccucgugaaaacaaacucaauaucaggaagauggcagcaagccaugagggauccucccccaugacccaaaccccucucaccaggucccaccuccaacauuaggaauuacauuucaacaugagauuuauuuauuuauuuaggagacagggucucacccuguugcccagguaggagugccguggcacaaucauagcucacugcagccuuggccucucaggcuuaagugauccuccccacucggucuccugaguagcuggaaccacaggugugcugaccaccaucuggcuaauuuuuucuuuuuguagagacagagucgcagucucauguuggccaagcuggucucaaacuccuggccucaagcaauccucccaccucagccucccaaagugcugggauuauagguaugagucaccacccuggccauaacuacagaucuagaggagucacauagccaaaccauuauauaucaucauaugugauuagaaaacagcauauucaaacaagauaucacuauacaccuuuuacaauggccaaaauccaaaaaucuggcaauaucaaaugcugacaagaauguagagcaacaggaacucucacucacuacaggugggaaugcaaaauggugcagccacuauggaagacaguuuggcaguuucuuccaaaacauacuuuuacuauacuauccagcaaucaggcuucuuguuauuuaucccaauaaauugaaaacuucuggccacaaaaaaaccugcauacaaauguuuauaagcaccuuuauucauaauugccaaaauccacaaaccaccacuagcugacuggauaaauuauggugcauucagacaaaaaaagaaauuagcuaucaaaccauggaaagaaagaaugaauccuaaaugcauguuauuuagugaaagaagccaaugugaaaaggcuacauacuguacaauuccaucuauacaacauccuggagaagguaaaacuauggagacaguaaaaagauuagugacugacaggggcuaagggggaaggaagaaugaacagacaaaauaaacaggauuuuuaggcaaugaaacuauuuuguaugacaccacaaugugggauacaugucauuaaacauuugugaaaaccuauagaauguacaaugccaagaauaaacccuaauguaaacuaugaacacugggugacaauaauaugcuaauguaaguucaccacuggaaacaaaugugccagugugcuggaugucaacagugggaaaaagaggggguggaauaugggaacucuacuuuccccucaauuuugccauaaagcuaaaacugcucuaaaaaauaaaguuuauuaauuuuuaaaaagugaacuaggggaaauaaaauuuuugugccuaucuagaaguauucaccauuuuacucaaacugcauuccugucccuuauacaccaccuuuaaccauuaaauccaaugccuuuuuugauuuugcauccuccuuguccucauugccuugaaauaaaucacuguaaaaauggaauacaaauggguaaagaugcaaggcagaaggguuucacccagaacaagcuauauaacuugcuaacugucaagaaacaucauuaaauagcaaaagucaagaugacugcuccaggauauauaacuuaaacucaagugagucaacuauuaagaguugaugggauauaagguuguugauccauuuaacaaagcucgaaagugacuaauauagaaaccacaaggacaauuuaucuauuaacaacaacaacaaaauuaagccaggcacgguggcucaugccugugaucccagcacuuugggaggccaaggagggaggaucacucaaguccaagaguucaagacgagccugggaaauuggugagaaccugucuauacaaaaaauaaagcauuagcugggcaugguggcaugcaucuguagucuuaguuaauaggaaggcugaggugggaagaucgcuugaaccugggagguugaggcugcagugaacagugauuacaccacugcacuccaaccugagaaacaaagcaagaccuugucugaaaaaauaauaauaauaaaauaaaauacaugcaugccugcauguaucucugcccagccuaaucuccccuacaagccuacuaagugggaagccaaacuguaauccuaagauucccuaaugaagauugccaacuaauaaauuucaacgaaauuacaaauagagggaaaaaccaccauuuuacaguaucauuacaagaaaauaaaugauucagguaaaaauaaucaacggcuauuaaaaccaauggguacuuauuauuuauuaauuauaaagggaaagguauuuuucauaauagcaaaaucuggugcaacccaccuuaaccaaguccaaacuuagguacaucaucaauaggauaauugacgucaugugcccuuauguacugagaacucaugaccuauggcauaucucugccaguaaugguuaaucuaaguguaacuaugagaaaacaaucaaauacaaauugagacacauucugcagaacuauccuaaacucuucaaaaauguuaauguuacaaaagaaauaaaaagcaaaaaggacuguucuagauuaaaggagacaaaaaagacauaacaauuaaaugcaguucauuaaaacagacaaauauaaacgacacuauaggaauaacugacgauauaugaauaauacauuaauguuaaauucauuauauuugguuuuguaggcuauuguccuuauucuugggaaauacaugauaaaguauuucaauggaaaagaacaagaucucugcaacuuacuuuuaaacaguucagcaaaaguaauauauacauguguguauaaagagaaagggacaaacuaaaaugugacaaaauauaaaguugcucaguauucuugcaacuuuucugcaaauuucaaauuuuccaacacaaauacuugggguaaaguugaacaugcaaucuggacccaaaaaaaagccuauauccaauaaaaacauuuacauaauaacaagaauaacuccaccagaaacagauuccauccuugggcuaaaaaaagcccacucacuuguacuuagaugacaccugacaagcuaacccuuaauaaggcuccauuuuacaugaguccauuaugaccacaucguuugcuacaaucccuauuauuuaaauaagccaguauuaccaagcagguacugucaggucuuucuaaccagaaaacuuguguaauucauugcacacugauuuaauugauuucgugugguuuaauucucugagaaaacaauucuuuccaaguugguuugaugacaucguugcugccacuguuugagaaggaaucuuuauuuuuugucauauuacaucaacuucaagaaugucccagcuguauucagaagaauaaaugaaagucugucauauaaucaagguagggagaaacgugucccaacagaagaaauaguaaauggagaggcauaaaauugcuucugguauauauauaugguauauauauauauaugguguguauauauaugguauauauauaugguguguauauauaugguauauauaugguguguguauauaugguauauauauaugguguguguauauaugguauauauaugguguguguauauaugguauauauaugguauauauauaugguguguguauauaugguauauauaugguguguguauauaugguauauauaugguguguguauauaugguauauauauguuauauauauaugguguguguauauaugguauauauaugguguguguauauaugguauauauaugguguguguauauaugguauauauaugguguguguauauaugguauauauaugguguguguauauaugguauauauaugguguguauauauauggcguguacauauaugguauaucuauggcguguacauaaugguauaucuauggcguguacauaaugguauaucuauggcguguacauauaugguauauaucuauggcguguacauauaugguguauaucuauggcguguauauauaugguauaucuauggcguguauauguaugguauauauauggcguguauauguaugguguauauauaugguguguauauguaugguguauauauaugguguguauauaugguauauauaugguauauauaugguggguauauauaugguguauauauaugguguguauauauaugguguguauauauaugguauauauaugguguauauauaugguguguauauaugguguauauaugguguguauauaugguauauauaugguguguguauauaugguauauauaugguguauauaugguauauauaugguguguauauaugguguauauauaugguguguauauaugguguauauauaugguguguauauauacgguguauaugguguguauauauacgguauauauaugguguguauauauacgguguguauauauaugguguguauauacgguguguauauauauaugguguguauauauacaguguauauauacgguguguauauauauaugguguguauauauaugguguguauauauaugguguguauauauaugguguguauauaugguguguauauacaugggguauauauaugguguguauauauaugguauauauaugguguauauauaugguauauauaugguguguauauaugguauauauaugguguauauaugguauguauauauaugguguauauauaugguauguauauauaugguguuccuuauauaugguguauauguauaugguguauauauauaugguguauauguauaugguguauauauauaugguauauauauaugugaguguguguguguauacguuuaugcauauguguauacugggucacagguguaaaaucuauuucuuuuagugagucauggucaaaauuauaucugaaggccacuacucuguaaacaauagauccacaaaaggauuuuaagaaaguauaaaauuugucuacugaaaguaaaauaaagcaauuuuucaaacugcugggaguuucaaauucaauuuaguugcuuucuaccaguaauuuuuaaguagaguauaacagaauuaaaaugaaaauagaauuguaucacaaguaguaauuuuaaagguuauuuuucauuaaaccuuugcaguuuuuuuuuuaauuuaaauauacacauaagcucugugucauaauguaucaggaauuucuuaauuuuuacuuggguugaaguuaaacauuuugaaagccaauaauaaagaguuaucaauuggcugaggaagagaucaguaaaagggaaaaaaguaacagaccacucuaauaggagaagaaagagaaaaugagggugugaaucaaaguaaaggaaauaaaaaagaaaugucagauccuuuugggaggccaaaugcgaguggaucacuugaggucaggcauucgagaccagccuugccaacaugugaaacccugacucuacuaaaaaaauacaaaaauuagccaggggugguggcacgcaccuguaaucccagcuacucgggaggcugaggcaugagaauugcuugaagcgggagguggagguuucagugagccaagaucaugccacugcacuccagccugggcuacagagcgaaacuccaucacaaaauaauaauaauaaaagaaagguguuagaucuauuucggagguagaauagaacaaucuagauaacugguuagagugggaaaggagaaaaagagaccgacuggccgggcacgguggcucagaccuguaaucccagcacucugggaggcugaggcaggcagauuaccuagggucaggaguucgagagcagccuggccaacauggcgaaaucccaucucuauuaaaaauacaaaaauuagcugggcgugguggugugcgccuaugaucccagcuacucaggaggcugagacagaagaaucgcuugaaccugggaggugaaggguugcagugagccaagaucacgccauugcacuccagccuaggcgacagagcgagacuuugucucaaaaaaaaaaaaaaaaagaaaaagaaaaagagacugacugaaaucuuaaaaaaaaguuuuuaaauaaaaaguuaagaagagaauugcauuacaauuccacauaucuacacuacaaugcuaugcacaagccauuaccauagcauucaaagcauaauacaauuuuucuccuauuauauuuaaacuuuuauuccacuguacucucucaagggcccugugcacuaggaagauaauaccauuuccacaaaaauuaauuaaaagguaccauucauugccaggcgcgguggcucacgccuguaaucccagcacuuugggaggccgaggaggaaggaucacgaggucaagaaaucaagaccauccuggccaacauagugaaaccccaucucuacuaaaaaauauaaaaauuagcugggcgugguggcacucgccuguagucccagcuacuugggaagcugaggcagaagaaucgcuugaacccgggaaguggagguugcagugagccgagaucacaccacugcacuacagccuggcgacagaacaagacuccaucucaaaauaaauaaauaaauaaauaaauaaauaaauaaauaaauaaauaaauaaaugguaccauuaucuccgcagcacuuuaaaaguuguaugauuucugacacuaacuuuaauguuaaauguuauucuaucacauagauaagguucuuaaaaaacaaugucaaaacaaaaauauuagguuauuuccuauucacuuguuaaaauuucaaaaacagcuucaugauaaaaagauuuugaucucaaugaccauacaaaaggaagauauucaggaauccuaauauuaacuagaggauaugauuuccuguuagugugaggguuguguucuuuuuuuccaaauucccugagaaauuaaucagauuuaugugcuaaccaaacacaaacaaauacaaacaaauaguuauauucuuuuuaauuacuaaugaugacaaauguggagaauuacuacaugauuccaaagaacuacuaaaucuaacugaaauuucauuucuucuaccaccagcaauaaagcauugcaguguccccuaagucuaaguagagaacaguuccacuccagauaccuggauuagcuuucuucaucaaggaggaacuaaaagacaguaaaauauuccuaaauuuucauauggucacuacuuaaugcagugauuaauaauaauuucuucuaaauccaugcuuuggcagccacccuaaaacccaacugaugugagugaacaacuaagcuuaccaucugccuaccuaccugucugucuauauagagagagaaagcaaccuauagucacuuaagugacauaauguaugaaagaauuccuauaccguggcuguucaauaaauaagaaagcuaacaaugguuuaauuaaaacacuacaauugcauccucacuucaucacugauagguucuuagaaacugcagccuuaagaaaacaacauagaauagguccucaaauaacaucauuucauuguaacacugauaagaaaaaaauuggguuucguuauauguuguuucauauuucugcauuugucuugaaagaagauuuaaaaaucugucaaaaagaaaaggccuucaaccuuaaggagguauuuguugauacaaauaucucuaaauaaaugcauacacagaaguaucaaagcucauuucucuauugccugagauaaccuccagaaugcaugcaaguacaugaauauccauaaauacugaacuacccaaaauaaacacuguauuaagucccuuaagauggcuauaacacccuaauuccuccucaaagaacuucauucuccuacugaaacaauuuuucugaagcauccaggaagaaaaacagaagugggaauguagcauaguaguuaaauagacuuaggggucaaaagcuuggguuuguaucacuugguaggcucugugacuugggaaaguuaccuaaaacccuccacaucucaauguucucauaugugaaaauguuagcuauaauuauauuuagggggauagggauauauacagauguauuuuagauauauauaauauacaaaaacuuaacagugauuauuaccuuugguaguaaaaguaaggauugguuuuucuucauauuuucuaauagucuccaaauuuucuauaguaaacauauauuaaucauauuuaggggaaaagugauuauuuaaaaauuaucuagaagccaaaaugcccaacauacaaucaaaacucacccaucauaccaagaaccaagaaagucacaacuuggaugagaaaaagaaaauaaacauguuaauguugauguguauuagauguuggaaagguuuuuaauuuucaaucagcuaucauuaaaaacacuucaacaaucaauuacaaauucuuuuaaaacagauuuaaaaaauagaaaauuucagcuaagaaaaagguuguaaaaccaaccaaaugaugauaaaacaagcuacaauaacaaccaaaaaaaaaaaaaacacaaaaaaaaaacaaaacuuacuagauaggugaggaaauguugaucaaaggagauaaauuucaguuaagaggaauaaguucaagagaucuaugguacaaacaugguguccauaguuuauaauaauaauuuacugcauacuuuaaauugcuacgauuguguuuucagcacacacaaaaaaaaugcugaguacguaagguaacgcagguuaauuagcucaguuuagucauuccacaauguauacauauaucaaaauaucuguuguacacaacacacauacacaauuuuugucaauuuaaaaauuauuuuuuucaacuuaaugggcucaauagcagaugacagaagacagaaucugugaacuugaggaccaacagaucaauagaauuuaccccaucugaacaacaggaagaaaaaugacuaaaaagaaguuaaaagucuugaggaucuguaagacaguaacguaagaucuaacuccguaucacuggagucccaaagaaaagagcauggaauugaaaggguauucaaaaauaauggcugaaaacauccguauuuggagaaaaacauaaaccuacagauccaggaagugaucaaaucucaaacagguaaacccacagaaacccugacauaucacuaaacuucugaaaacaaagauaaagauuuugaaagcaauuacagagaaaagacacauuaccuuauaggggaacaccaauucaaguggcaagagauuuaucaucugaaaccacaaaggacagaagaaaaguggcacaaaauuuuucaacuucugaaagaaaagaauugucaaccauaaaucuuauuuguggugaaacuaucuuucaggaauaauggugaaauaaugacauuuacaggcaaaaggaaaacgaauaaauuguuacuagcagacauaccuuuaaagaauaaggaaauucuucaauaaaagaaggaaucuugaaacaccaagaaagaagaaaaaacaauaagaaaagcagaaauguagauaaaaacaacagacuauccuucuacuccagagguuuucaaaucauaguugaugacugaaauaaaacuuauaggcaacaaaagaaaaaaacaaguaagcuggaauucaucaaaauuaaauuaaaugcaucaaaagacacuaucaacaaaacuaaaaaguagccuguggaaugggcaaaaauauuugcuaaucauauagcugaugggggauuaauaucaagaacauauaaagaacuccuacgaaaacaaaaaaacucaacucgaaaauaggcaauaggcugggggcgguggcucacaccuguaaucccagcacuuugggaggcugagacugguggauuacuugaggucaggaguucaagaccauccuggccaacauggugaaaccccaucucuacuaaaaacacaaaaauuugccgggcgugguggcaugcgccuguaaucccagcuagcugggagguugaaacaggaggaucgcuuaaacccaggaggcggagguugcagugagccgagaucgugucacugcacuccagccugggcaacagaacaagccuccgucucaaaaaaacaaaaacaaaaacaaaaaugggcaacagacauuucuucaaaaaaaagauauauauauaaauggccaauaagcacaugaaaagaugcucaacagcacuaaucuuaggaaaaugcaaaucaaaaccaguuacuacuucacacccacuaggauagcuauuauuaagaaaauagaaaauaaaaaguguuggcacucgggaagcugaggcaggauaaucacuugaacucaggaggcggagauugcaguaagacgagauugcagugagacgagauugcagugagacgagaucacgccauugcacuucagccugggcaacaagagcgaaacuccgucucaaaaaaaaaaaaaaaaguguuggcaaggaugcagagaaauucuaacccuugugcauugcugcugggacuauaaaaugguguggucacuguggaaaacaguaugaugauuccuuaaaaaauuaaaaacagaauuaccauaugauucagcaauuccaugccuggguauauacccaaaaugaaagcaggcacuggaacagauauuuauauaccaugugcacacugggaaccauagccaaaagaugcaagcaacccaaauguucaguggauaacuggguaaacaaaaggugauauauacaugcaauggaacauuauucagccucaaaaaaaaaaaaagaaauuagccaggcgugguggcaggcgccgguaguccagcuacucgggaugcugaggcaggagaauggcaugaacuggggagguggacuuugcagucagccgagaucggaccaccauacuccagccugggcgacagagugagacucugucucaaaaaaaaagaaagaaagaaaauucugacacauguuacaauauggguugaaccucuugaaacucaacaauuuaaaaaaauccaauuugaaaaugggccaaagacacagacauuucaccaaagaagguauacagauggaaaaagcacaugaaaagauuuuucaagcugggcgagguggcucacgcuuguaaucccagcauuuugggaggcugaggcagguggaucacuugaggucaggaguucaggaccggccuggccaacauggugaaacccugucucuacuaaaaauacaagaauuagccaggcgugguggcaggugccuguaauucuagcuacuugggaggcugaggcaggaaaaucgcuugaaccuggaagguggaaguuguaaugagccauuauugugccacugcauuccagccuaggcaacagagcaagacacugucaaaaaaaaaaagaaagaaagaaaaagauuuuccaacaucauuacugugaugguuaauauuaggugucagcuugacuggacugagggaugccuugauggcuggugaagcauuguuucugggugugucugugaggguguuuacagaagagacuggcaugugagucagugaaugaggagaguaagacccacucugggugggcaccauccaaugcagucggcugccagaacaaagcaggcaguaagagaaacagagccagcgugcugaguuccccauccccuucuagugagggauauuuugcuuuugcccucaggcaucaaacuccagguucuuuggucucuggacuccaggacucaggcuagcagccucccugggggucucaggccuuuggccucagacugucagcuuuccuggcuuugaggcuuuccaacuuggaugugguaccagcuuuuuucauuggcuagcuugcagaugaccuauugugggauuuugacuuuguaauggcaugagccaauucucccuaauaaacucccuuuuauauaugcauguaucuuauugauucucucuggagaacccugacuaauauaauuagacauuagaaaaauguuaaucaaaaucacaaugagauaucaguaaaaacagaaaggcuaaaauaaaaaaugauaucaucaaaugcugguuaagacacagagaaaccggaucuuucacacauugcuggugagaauguaaaaauauauagccauuauagaaaaugcuggcaauuucuuauaaaagugaacaugcaacuaucauacaauccaguaauuguacucucggggacuuaacugacagaaaugaaaacuuauguucacacaaaaacauauauacaaauguuuauagcagcuuuuuuuuauaauacccaaaacuagaaaugacccaaauguuccccaauggcugaacgguuaaacaaacuguggcacaucuacaccauggacuacuauucagcaaugaaaaaagggcaaaauauugauacuucaacuuacacgaacuugacaaauuaugcugagugacaaaugccaaucccaaaagguuacauacuauuugauuccauuuugaggcagguuaucauucugucacccaggcuggagugcaauggcacaaucauaacucacugcagccucaaccucauaggcucaggugauccucccaccucagccuccugaauagcugggacuauggugugcaacaccacgaacagcuaauuuuuguuuuuuuuguagagacaagguuucgccauguugcccaggcuggucuugaacuccugggcucaagcgauccaacugccucagccucacaaagugcugagauuacaggaaugagccauugcacccagcccgcauaaucuucuuuaaaugaccacaggaaaaaaaaaaaaaaaaaaaaaaaagaacaaauuagcaguuaccagggaauaaggaaagaggaaggagacacucugguuauaaaacacagcaugagagauucuaguggugaagaaacucuucuguaucucuaguaugguaaugauuauacaaauuuacauguuacaauacugcauagaacuaaauacuaaauauaucacacacacauacaugcacacacacaaaugaauauauguaaaacuggugaaaugugaacaaaauagguggauuacagcgaugucaauguccugguuuugauacugcacuauaguuaugcaagauguuaccacugagguaaaauggaugaacaaguacaucucuaacuuauuacuuuuucuuuucuuuuuuuuugagacagagucucgcucugucgcccaggcuggagugcaguggcaugaucucggcucacugcaaacucugccucccagguucacgccauucuccugucucagccucccgaguagcaggcacccaccaccacgcccagcuaauuuuuuuuuuuuuuuguauuuuuaguagagacgggguuucaccguguuagccaggauggucucgaucuccugacccugugauccacccaccucggccucccaaagugcugggauuacaggagugagccacugcgcccggcccaucugucuuauuucuuaaaacugcauaugaaucuacaauuaccucaaaauaaaaagauuuaaaaauuagagaaaugaaucaacauuuagauagaaaagaauauaggugagauacggucuaucguuacacaagugucuaauaugaacccaguuuagcaaguuauuccuacaaaaaacacuuaaaagaggugagggagaucucuaagucuuucccuuagcuugagacagauguauuagcgaaauuuuuaaaguaaaauguuacaacaaugaacacacauugaauacagaaaauuugcuggaguaacagcuuauccauaggauauuccauggcuaccauggucauguguaggaucuuuccacacuauaauaaucagacaugcauuuaaauaugcuuuccaucuuucaacagagguacaaucaaaaaagauaaaggucacugacuaacaaagaaagagguaaaguaaggcaagauuuucucucccacagugaaagaaauuaaaagaaugaggaccuuauuucucaagcagcagacaugcauuuaaucuguuccaaaauaauccaaauccauuuuuaaagauguagaguuacccauguauuagucaguuugggcugcuaugacgaaauaccagagucuggguggcuuaaacaacagaaauuauuuuuucacaguucugcaugcuggaaauugaacuaucaaagugcuggcaagcuugguuucuggucaggccucucuccuuagcugacaaaugaaggccuccucaccauguccucacaugaccuuuucuugaugcacucauacuccugguaccucuucuuauaaagguacccguccuauaggauucaccagccacccuuaugaccucauuuaaccuuaauuaccucuuuuaaaggcuguaucuccaaauucaguuacauuggugguuaaggcuucaaccuaugacuaugggggacaggggggaacuauuaaguccaaaaugccaguuacugccagcccugaaguacguuaaguuuuaucugggugcauauauguguguacauucuacguaauggaaaggggcaagacaaaauaaaaagcauaguauuuacauuaaaauuccagcucuaucacucaguuuccucaacaaugaggaugaugcccauucucacuauaucauuguaagaauuaaauaagauaaucuauauaaaguaccugacaucuagcaaaugauuagcaaauacugagccuuugcuucuaguccucucuaaaauuuaaaaaaaaaugaauuauaaauauuacucaaaucuaaauauaugugaaacaguaugagaaucggauucugucccaguucuaccacuaccuaguuauaugaacuuagcuaggguguaggguggagugaagcaagucacucuaccuaaggcuacuucuguaucuaagcagagaagcuucccucuguaacuaaaacucuauguuacacauaacaacuugacuacaauuugaaacacaaauguuacaaaaguuaaucacacuuucucacuguaauaauccuaaaugaaugauacugaaauuuccuucaagagaauuaugguaugaaauuucaguaucauucuuucauuuacuuucauucuuucacucuuuggcaacuauccucugaauuugaaaaauuuaccugcacaacguaucuguagacuacuuuuaucaucuuauuucccuaccaguaaugccucaucuuccaacuagacuguagaauuguauauuucuuuuugucccccauacuguucauuauuuuacucacuaaaucacauaaccacuaaaacaccuaaaaucaucauacccuaaauccuguagagaugugacaagacauacauaguuaucaauaaguuguaucuaauaacaacaauuuuuaacgcagcacaaaacugaaauguacugccagugauuucaagguaacacagaaauaccugcauauucaaacaauaaacaacauccguauucaguauuuuugguuuaaaauuaagguaaugguagccaaaaagcaacaucuauuguggagaaauuugacucauuuaacaaaagacaacuuagcuugcugggccugaaggaagaacucauaaguauuuguccuaucucccagccugucccucacuacuaguauucuauuaucucguauuacaugaaaauaaguaauacacaugguacuguuacuuugaugcccugaggaaagcucaacuugcuguauucaugccauuuuauaguccccucccauauuuaaugcacacuggguuaugugaccagcacucaccauuggaacauuagcaaggaugaggaacacagaagcuugauaaauaccggcacacuagggcuuggaaaggucuuucacggaacugccauagcugccaugcuaugaagaaggccaagcuggcugggcacaguggcucaugccuguaaucgcagcacuuugggaggccaagguggcagaucacgaggucaggaguucgagaccagccuggccaacauggugaaaccccaucuccaugaaaaauacaaaaauuagcuggacgugguggcacgcaccuguaaugccagcuacuugggaggcugagacaggagaaaugcuugaacccggaaggcggagguugcagugagccauaccacugcacuccagccugggcgacagggcaagacuccaucucaggggggaaaaaaaaaaagaaggccaaccuucuucaaguggagagacgacauggguaggaagagagagggaaaugcccagccaucuaccagcugcuccagccaucccaguugaggcacuagauuuaugaguuaagaagccacaguggacauuauagccaacagaucacauguggagaagucaccauaaagccauacacaaauuuuagaaucaagggcaaauacacaauuguuuuagccacuauguuuuggagugcuuuauuaugcagcaauagauaaccaaaacaauacaaauaaaccaauuagaacuguuccuguuuggcaguaagcaacaacaacaaaaaaugucagugguaaccauuguuauaguuaauaaucacuauaaaaaaucuucuucccaaaagguacuuuucuggguauuuaaguguucuuaaagggacucuguucauuucaccaauggccaguaaagagagagaaguaaagcaaccagaaagucuacucuucguuuuuccuuuucccuuccuaauuuauggcuguccuuuuuagcuuugccaguaauguuugccuguuuuccccagaguggcuaaucaaugauccauaccgauucuagcauucaacugugcucuguaccucagucacuacagacaucaccgucaacuucccuccagaccacagguaacuaaaaguucuguagaccagacucuucacuaagggugaaaaguuuaaacucaucuaauucauaauuauguuuuccugauagaaucauuaagcgaagagcaucagaaccaauaaccucuugcucagaaaauaaauuaaguagcaggaaaaacauaccugcuauuuuuccucaaagaauuuacugauccuaauuacacaaauuucuuuuucuuuuaacccucaugaccuuugcucauacuucacucgugauauuuaucuuaaccuagccugaaucacaguaauugguuuacuuaauuuccuacuagaucuaauacucccuuuucucccauugagaaaaggggcauuuuacucuugcaacccuugaagcaccuacuauauuucucugcuacuuauacaaauacaguaaaaaauaugaguucuggucaucaaucauuguccguaacuaaucuuagcaagucucacccccauuuuuauuaagaaacaauggcucacccauauguauaaugcaaucagugacaaaguuaaugaaugcuacauguucuaacauuaaccuucaccaauuauuugacuuaauaagaaugauuuuauuuuuguagagacaguaaaaugauuuuuuuaaaaaagaaagguacuauuuacauuccuuauuuucuuuuccuuaaaguuucagacuugagaagucugaauauuagguucagcauaagauccaggccagaugccaggcaaauacugcaauagcaaaggcaaagcagaccugguggagacugcaaauggagaccucaguacccaccuaaaagggucaaccgcuacucagcucuggcaaucuagucucaagcaggaauggccaccagguauagccaaguccuguggguuuucuagagaugcuagaaguugagacuucuuaaauaugaaaucuuccuauuggccgcgagguggcucacgccuguaaucccagcacuuugggaggccaaggcaggcggaucaccugagguuaggaguucgagaccagccuggccaacagagugaaaccccgucucuacuaaaaauacaaaaauuagccaggcauggugguguguaccuguaaccccggcuacuggggaggcagaggcaggagaaucaccugaauccgggaggcggagguugcagugagccaagaucacacuacugcacaccacccuggguaacagagcaagacuccaucucaaaaaaaaaaaaaaagaaaaagaaaaagaaaagaaaucucuauucuuaaauggugacaauuaucaaauauuccaaauacucuaagggcaagcaguauauaucuguggguuggauucucaccaauggccacuugcuacugcagacucacaguuaaaaaucucuacauauaacugauggugcacuacacaaacaauauaccuuuaccaccacugccccucacccugcagaagaaaaaaaaugagaaccaugaaaagaaacuccaaaaaauuauggaguacuagugacaaacuucuuuaauuuaaccuuuucucucucgaaaaagaaaucuguuaacaguuuuagauauagaaacuuuuauaguagagaaauagagaggaagaauuuuuuuuauuuuuauaauuuucucaaaacuuucaaaaauauucaaauaaauaguacaaauuacauaaacauuuccagccucaaccaaacuaaugaaaaugcucaguaauaaaaaugagacuaaugauucaccacguacacagaaaaacaagguacaaaauacuaauuaauaguguuaauuuauuugcacugguguaucuacauauugucauuugacucuuuugugaucaauagcacaaaacugggaacaaaguugaacuaacuuccugaccauggaacacucgaguaacaagccacuuguggacucaauccugugaccuaaacccccuuaauaccaugcuauccauaacuaaggggaccaguuacucauagucaguauuuaguccaacauuucuucaauacuuuuacaaaagauaaauauuauuugaaaaugucuuuaaggcuuuuccuuccacuuaaaaauaugaauaucuacauucaggaauaggaauuuauagagaacacuugaauuucaccucuaaaauugcuuaaccuacugcuagaagcccuuauaaaguuaaaauaaaauucuuaauauaauuaaucgugguaggcuugauuuggaguucaaaacauucuguaaaauagucauuuaacaagggagauucucuaaccaaaagaauuaguagacaauuuagugcuaguaaaauauuacaguuaugggcacaggggacuacguauuuaucgaacacuuacuaugcccaaguacugugacgaauacaucaagguauucauuaaaucuuaaaaaaaaaaaaacaaucauaugaggaagguaccauuccuauccccauuuuacggauggggaaacugaccuuuccaagaauacccagcuaguaaguggcagagucaggauuccaacccaaaucuugucuaacuucagaaucugcacgcuuaaccacuacacugcauugccuccagugacucuggguugauaacuaagaugaaauaagaaggaaauuuguacuucucaguggcaaauuuuaaaaacauauuauaaauggaggguauuuuuuagaacaugaacaaguuucauauacauagucauacaauuuuuauuuccaaauacauguaguaauggugaaaaucccacacaaugaauuucucacaauuuuucauaaguacucaaucaugguguuuuuuuuuuuuuuagacaggguuucguucuugcugcccaggcuagagugcaacggcagaucucggcucacugcaaccgcccccucccugguucaagcaauucugccucaaccuccagaguagcugggauuacaggcgcccgccaacacgaccggcugauuuuuuuuuuuuaguagagacgggguuucaccguguuggccaagcuagucucgaacucugaccucaagugauccacucgccuuggccucccaaauugcugggauuagaggcgugaagcaccacccccagcccaaucguguuuauuacuaaaaauuuaaugggaacacccuguauuuuccccucaauuuugcugagaaccuaaaacuacucuaaaaaacagucuauugggccaggcgcgguggcucacaccuguaaucccagcacuucgggaggcaaguggaucaccugaggucagaguucgagaccagccuggccaacauggcaaaacccugucucuacuaaaaauaugaaaauuagccaggccugguugcgggcaccuguaauccuagguacucaggaggcugaggcaggagaaucgcuugaaccugaaggcggggaggggcggggcggagcuugcagugagccgaaaacacgccacuucacuccagccugggcgaaacagcgaaacuccaucucucaaaaaaaaaaaaaaaaaaaaaaaaaaaaaaaagaagucuacuaaaaacaguuuuuuuuaacuacaauauccuaaauauaccuaauuuaguuauaaacuagcauaagacuagauucuuucaguaugaaaaguugcauuguuuuucauaaccauuguaccaagcaugcuauuagcauuuaauaaaaauugaacuauuuuuuucaaaagcagugcuguaauauuguuuuuuuguuuguuuguuuguuuugagacgggguuaagcucuuauugcccaggcuggagugcaauggcaggaucucggcucacugcaaccuucgccucccggguucaagcgauucuccugccucagccuccuaagaagcugggauuacaggcacccgccaccacgccaggcuaauuucguauuuuuaguagagacgggguuucuccaucucggucaggcuggucucaaacuccggacuucaggugauccacccgccucggccucccgaagugcugggauuacaggcgugagccaccgcgcccagcaaaauuggaauuaacacucccagaauacucccagggacucugcauuacaaagacauuaaaauaugaaccaaacucugacgaaagacuugaauccuuuauugaggaauauaaaaaguggaauacuacaucccguuggcuggcauaaauaugacuaacuuuacuuuuccccuuuaaguaucaaaagauguagccuuaagucaaaaauggauuaggguaacagaaucuuuuccuaauuaguuucagaacuuucuaaaugcuccaaagaagcuuauccaaaaaaaaaaaaaaaaaaaaaaaaaaaaaaaaaaaaaggccgggcaccguggcuuacggcuguaaucccaccacuuugggaggcugaggccggcggaucaccugaggucaggaguucgacaucaguuuggccauauggcgaaauuucgucucuauuaaaaauacaaaaauuagccagacaugguggcaugcgccuguaaucccagcuacuagagaggcugaagcaggagaaucucuugaacccgggaggcggagguugcagugagccgagaucacgccacugcacuccagccugggcaacaaggcgagacuccaucucugggguggggggaaggaaaaaaaaaaaaaccucugaauuguccagagugacugucaacauaugaaccaaaucuuuuuuucuugauauucaacaaaguugucaaaauucuuuuuuuuuuuuuuuugagacagagucucgcucugucacccaggcuggagugcagcggcacgaucucggcucacugcaaccuccgccuccuggguucaagcgauucuucugccucagccucccaaguagcuaggauuauaggcgcgugccaccgcguccggcuuauuuuuguauuuuuaguagagacaggguuucaccagguuggccagguuggucucgaacuccugaccucaggugauccgcccaccucagccucucaaagugcugggauuacaggugugagccacugcgcccggccgguuguuaaaauucuaagggucaauuaaggguuauaugagaaaucuauaacaaguuuugccuaauaacacuucccaucucaacauuuucaucaagguccaccuuuaagaauaaacaccuaaguucaauuaagacaagugaggaggagguauuaacuuacauuuuaaaaaagucauuguccuguauauuuuacagacuguaaaacuuaauuuuuaaauagaauacuauacuggccaccaacaaaaaauguuuaagggaagcucuauugauuuuguuuugccucacuguuguacuuccaaagucuccacuauaaaagcagugcguuaauauuaaguggcaagccuauggaagaagauacauuguuggaauauaggcucuuaaucacaccuauaauacacaggauuccuuuccuuucucucugacccaaguucucauuaagugacccaaagacucuucugcaucacuaugcuuucucuaaucagaagcugggcugugcacugaaauaaaaacauucuaaccaauacauuuuucaaauuauuacuauaguacucguuuaaacaccuguauucaaagcuucucacuaaucaucuagcuuuaucaaguaacacacacaaguuaauauacacuaugacugccuugguagccgcaguuugacuaaauucugggacaccaccucaacuuggaagggacagaacuauauccgguucucauuagauacacauuuucucaugcuuuccaucuuaaagacuuuacacuuucccagaggagcaauaaauguaggaagacgccagguaguaugccuguaaggaagauaagugaucagauuaaauuccuacccaagaaaccugaaacuucaaaaacuuuuccuaacaaaccacagaugaaaaggacaaaguaugauuuaccccuucauuuccacuucuuuucuggagccagcuucccaaauuccugaacagcagucuuaacuuacugguuaguuggaggagcggucaacgguauggccaccucuuccuccucguauucugguccauccagagagucaccuucguccacugucccgaggcccgcccccaaagggggcagguaagggggagggggcagagggggaaaaccgccgccuggcccgagagucucagcaagcaacgaagugggcaguuuggugagagccaugucuccacuagguccagcaacagcagcaccggccacgccagcagcagcaccagcuacgccagcagcaguaccucccccugucaguccagcuccccccagugccccugccacagacccggcuccuaggaacucugaccccaaagcggcuccgccacccagaguuccagccacuccggucuccaccagcccaggauagggggcggcugccacaggcagggccgcggguaucuucacccgacacacugcgggauaggcacuggagcccgcugccgcgccgccuccuccagcuccggcuguuaccgggccgcccuccucacugccggccucggccgccaucauguugaagcccgcucuacucugcccuacccugcccgcccgggagccccaggggccaccaggcccgggcuccgagcagccccacccagacgcgucuccccuucagcuccccaggcugaggaaacaacaacaaaaggagagagcccgccgccgcgcccccuccuagggccacagcccaggcuccccagcugccuggguuacg

SEQ ID NO: 193036 - RNA, 123674 nt, Homo sapiens
cguaacccaggcagcuggggagccugggcuguggcccuaggagggggcgcggcggcgggcucucuccuuuuguuguuguuuccucagccuggggagcugaaggggagacgcgucuggguggggcugcucggagcccgggccugguggccccuggggcucccgggcgggcaggguagggcagaguagagcgggcuucaacaugauggcggccgaggccggcagugaggagggcggcccgguaacagccggagcuggaggaggcggcgcggcagcgggcuccagugccuaucccgcagugugucgggugaagauacccgcggcccugccuguggcagccgcccccuauccugggcugguggagaccggaguggcuggaacucuggguggcggagccgcuuuggggucagaguuccuaggagccgggucuguggcaggggcacuggggggagcuggacugacagggggagguacugcugcuggcguagcuggugcugcugcuggcguggccggugcugcuguugcuggaccuaguggagacauggcucucaccaaacugcccacuucguugcuugcugagacucucgggccaggcggcgguuuucccccucugcccccucccccuuaccugcccccuuugggggcgggccucgggacaguggacgaaggugacucucuggauggaccagaauacgaggaggaagagguggccauaccguugaccgcuccuccaacuaaccaguaaguuaagacugcuguucaggaauuugggaagcuggcuccagaaaagaaguggaaaugaagggguaaaucauacuuuguccuuuucaucugugguuuguuaggaaaaguuuuugaaguuucagguuucuuggguaggaauuuaaucugaucacuuaucuuccuuacaggcauacuaccuggcgucuuccuacauuuauugcuccucugggaaaguguaaagucuuuaagauggaaagcaugagaaaauguguaucuaaugagaaccggauauaguucugucccuuccaaguugagguggugucccagaauuuagucaaacugcggcuaccaaggcagucauaguguauauuaacuuguguguguuacuugauaaagcuagaugauuagugagaagcuuugaauacagguguuuaaacgaguacuauaguaauaauuugaaaaauguauugguuagaauguuuuuauuucagugcacagcccagcuucugauuagagaaagcauagugaugcagaagagucuuugggucacuuaaugagaacuugggucagagagaaaggaaaggaauccuguguauuauaggugugauuaagagccuauauuccaacaauguaucuucuuccauaggcuugccacuuaauauuaacgcacugcuuuuauaguggagacuuuggaaguacaacagugaggcaaaacaaaaucaauagagcuucccuuaaacauuuuuuguugguggccaguauaguauucuauuuaaaaauuaaguuuuacagucuguaaaauauacaggacaaugacuuuuuuaaaauguaaguuaauaccuccuccucacuugucuuaauugaacuuagguguuuauucuuaaagguggaccuugaugaaaauguugagaugggaaguguuauuaggcaaaacuuguuauagauuucucauauaacccuuaauugacccuuagaauuuuaacaaccggccgggcgcaguggcucacaccuguaaucccagcacuuugagaggcugaggugggcggaucaccugaggucaggaguucgagaccaaccuggccaaccuggugaaacccugucucuacuaaaaauacaaaaauaagccggacgcgguggcacgcgccuauaauccuagcuacuugggaggcugaggcagaagaaucgcuugaacccaggaggcggagguugcagugagccgagaucgugccgcugcacuccagccugggugacagagcgagacucugucucaaaaaaaaaaaaaaaagaauuuugacaacuuuguugaauaucaagaaaaaaagauuugguucauauguugacagucacucuggacaauucagagguuuuuuuuuuuuuccuuccccccaccccagagauggagucucgccuuguugcccaggcuggagugcaguggcgugaucucggcucacugcaaccuccgccucccggguucaagagauucuccugcuucagccucucuaguagcugggauuacaggcgcaugccaccaugucuggcuaauuuuuguauuuuuaauagagacgaaauuucgccauauggccaaacugaugucgaacuccugaccucaggugauccgccggccucagccucccaaaguggugggauuacagccguaagccacggugcccggccuuuuuuuuuuuuuuuuuuuuuuuuuuuuuuuuuuuuuggauaagcuucuuuggagcauuuagaaaguucugaaacuaauuaggaaaagauucuguuacccuaauccauuuuugacuuaaggcuacaucuuuugauacuuaaaggggaaaaguaaaguuagucauauuuaugccagccaacgggauguaguauuccacuuuuuauauuccucaauaaaggauucaagucuuucgucagaguuugguucauauuuuaaugucuuuguaaugcagagucccugggaguauucugggaguguuaauuccaauuuugcugggcgcgguggcucacgccuguaaucccagcacuucgggaggccgaggcggguggaucaccugaaguccggaguuugagaccagccugaccgagauggagaaaccccgucucuacuaaaaauacgaaauuagccuggcgugguggcgggugccuguaaucccagcuucuuaggaggcugaggcaggagaaucgcuugaacccgggaggcgaagguugcagugagccgagauccugccauugcacuccagccugggcaauaagagcuuaaccccgucucaaaacaaacaaacaaacaaaaaaacaauauuacagcacugcuuuugaaaaaaauaguucaauuuuuauuaaaugcuaauagcaugcuugguacaaugguuaugaaaaacaaugcaacuuuucauacugaaagaaucuagucuuaugcuaguuuauaacuaaauuagguauauuuaggauauuguaguuaaaaaaaacuguuuuuaguagacuucuuuuuuuuuuuuuuuuuuuuuuuuuuuuuuuugagagauggaguuucgcuguuucgcccaggcuggagugaaguggcguguuuucggcucacugcaagcuccgccccgccccuccccgccuucagguucaagcgauucuccugccucagccuccugaguaccuaggauuacaggugcccgcaaccaggccuggcuaauuuucauauuuuuaguagagacaggguuuugccauguuggccaggcuggucucgaacucugaccucaggugauccacuugccucccgaagugcugggauuacaggugugagccaccgcgccuggcccaauagacuguuuuuuagaguaguuuuagguucucagcaaaauugaggggaaaauacaggguguucccauuaaauuuuuaguaauaaacacgauugggcuggggguggugcuucacgccucuaaucccagcaauuugggaggccaaggcgaguggaucacuugaggucagaguucgagacuagcuuggccaacacggugaaaccccgucucuacuaaaaaaaaaaaaucagccggucguguuggcgggcgccuguaaucccagcuacucuggagguugaggcagaauugcuugaaccagggagggggcgguugcagugagccgagaucugccguugcacucuagccugggcagcaagaacgaaacccugucuaaaaaaaaaaaaaacaccaugauugaguacuuaugaaaaauugugagaaauucauugugugggauuuucaccauuacuacauguauuuggaaauaaaaauuguaugacuauguauaugaaacuuguucauguucuaaaaaauacccuccauuuauaauauguuuuuaaaauuugccacugagaaguacaaauuuccuucuuauuucaucuuaguuaucaacccagagucacuggaggcaaugcaguguagugguuaagcgugcagauucugaaguuagacaagauuuggguuggaauccugacucugccacuuacuagcuggguauucuuggaaaggucaguuuccccauccguaaaauggggauaggaaugguaccuuccucauaugauuguuuuuuuuuuuuuaagauuuaaugaauaccuugauguauucgucacaguacuugggcauaguaaguguucgauaaauacguaguccccugugcccauaacuguaauauuuuacuagcacuaaauugucuacuaauucuuuugguuagagaaucucccuuguuaaaugacuauuuuacagaauguuuugaacuccaaaucaagccuaccacgauuaauuauauuaagaauuuuauuuuaacuuuauaagggcuucuagcaguagguuaagcaauuuuagaggugaaauucaaguguucucuauaaauuccuauuccugaauguagauauucauauuuuuaaguggaaggaaaagccuuaaagacauuuucaaauaauauuuaucuuuuguaaaaguauugaagaaauguuggacuaaauacugacuaugaguaacugguccccuuaguuauggauagcaugguauuaaggggguuuaggucacaggauugaguccacaaguggcuuguuacucgaguguuccauggucaggaaguuaguucaacuuuguucccaguuuugugcuauugaucacaaaagagucaaaugacaauauguagauacaccagugcaaauaaauuaacacuauuaauuaguauuuuguaccuuguuuuucuguguacguggugaaucauuagucucauuuuuauuacugagcauuuucauuaguuugguugaggcuggaaauguuuauguaauuuguacuauuuauuugaauauuuuugaaaguuuugagaaaauuauaaaaauaaaaaaaauucuuccucucuauuucucuacuauaaaaguuucuauaucuaaaacuguuaacagauuucuuuuucgagagagaaaagguuaaauuaaagaaguuugucacuaguacuccauaauuuuuuggaguuucuuuucaugguucucauuuuuuuucuucugcagggugaggggcaguggugguaaagguauauuguuuguguagugcaccaucaguuauauguagagauuuuuaacugugagucugcaguagcaaguggccauuggugagaauccaacccacagauauauacugcuugcccuuagaguauuuggaauauuugauaauugucaccauuuaagaauagagauuucuuuucuuuuucuuuuucuuuuuuuuuuuuuuugagauggagucuugcucuguuacccaggguggugugcaguagugugaucuuggcucacugcaaccuccgccucccggauucaggugauucuccugccucugccuccccaguagccgggguuacagguacacaccaccaugccuggcuaauuuuuguauuuuuaguagagacgggguuucacucuguuggccaggcuggucucgaacuccuaaccucaggugauccgccugccuuggccucccaaagugcugggauuacaggcgugagccaccucgcggccaauaggaagauuucauauuuaagaagucucaacuucuagcaucucuagaaaacccacaggacuuggcuauaccugguggccauuccugcuugagacuagauugccagagcugaguagcgguugacccuuuuagguggguacugaggucuccauuugcagucuccaccaggucugcuuugccuuugcuauugcaguauuugccuggcaucuggccuggaucuuaugcugaaccuaauauucagacuucucaagucugaaacuuuaaggaaaagaaaauaaggaauguaaauaguaccuuucuuuuuuaaaaaaaucauuuuacugucucuacaaaaauaaaaucauucuuauuaagucaaauaauuggugaagguuaauguuagaacauguagcauucauuaacuuugucacugauugcauuauacauaugggugagccauuguuucuuaauaaaaaugggggugagacuugcuaagauuaguuacggacaaugauugaugaccagaacucauauuuuuuacuguauuuguauaaguagcagagaaauauaguaggugcuucaaggguugcaagaguaaaaugccccuuuucucaaugggagaaaagggaguauuagaucuaguaggaaauuaaguaaaccaauuacugugauucaggcuagguuaagauaaauaucacgagugaaguaugagcaaaggucaugaggguuaaaagaaaaagaaauuuguguaauuaggaucaguaaauucuuugaggaaaaauagcagguauguuuuuccugcuacuuaauuuauuuucugagcaagagguuauugguucugaugcucuucgcuuaaugauucuaucaggaaaacauaauuaugaauuagaugaguuuaaacuuuucacccuuagugaagagucuggucuacagaacuuuuaguuaccuguggucuggagggaaguugacggugaugucuguagugacugagguacagagcacaguugaaugcuagaaucgguauggaucauugauuagccacucuggggaaaacaggcaaacauuacuggcaaagcuaaaaaggacagccauaaauuaggaagggaaaaggaaaaacgaagaguagacuuucugguugcuuuacuucucucucuuuacuggccauuggugaaaugaacagagucccuuuaagaacacuuaaauacccagaaaaguaccuuuugggaagaagauuuuuuauagugauuauuaacuauaacaaugguuaccacugacauuuuuuguuguuguugcuuacugccaaacaggaacaguucuaauugguuuauuuguauuguuuugguuaucuauugcugcauaauaaagcacuccaaaacauaguggcuaaaacaauuguguauuugcccuugauucuaaaauuuguguauggcuuuauggugacuucuccacaugugaucuguuggcuauaauguccacuguggcuucuuaacucauaaaucuagugccucaacugggauggcuggagcagcugguagauggcugggcauuucccucucucuuccuacccaugucgucucuccacuugaagaagguuggccuucuuuuuuuuuuuccccccugagauggagucuugcccugucgcccaggcuggagugcagugguauggcucacugcaaccuccgccuuccggguucaagcauuucuccugucucagccucccaaguagcuggcauuacaggugcgugccaccacguccagcuaauuuuuguauuuuucauggagaugggguuucaccauguuggccaggcuggucucgaacuccugaccucgugaucugccaccuuggccucccaaagugcugcgauuacaggcaugagccacugugcccagccagcuuggccuucuucauagcauggcagcuauggcaguuccgugaaagaccuuuccaagcccuagugugccgguauuuaucaagcuucuguguuccucauccuugcuaauguuccaauggugagugcuggucacauaacccagugugcauuaaauaugggaggggacuauaaaauggcaugaauacagcaaguugagcuuuccucagggcaucaaaguaacaguaccauguguauuacuuauuuucauguaauacgagauaauagaauacuaguagugagggacaggcugggagauaggacaaauacuuaugaguucuuccuucaggcccagcaagcuaaguugucuuuuguuaaaugagucaaauuucuccacaauagauguugcuuuuuggcuaccauuaccuuaauuuuaaaccaaaaauacugaauacggauguuguuuauuguuugaauaugcagguauuucuguguuaccuugaaaucacuggcaguacauuucaguuuugugcugcguuaaaaauuguuguuauuagauacaacuuauugauaacuauguaugucuugucacaucucuacaggauuuaggguaugaugauuuuagguguuuuagugguuaugugauuuagugaguaaaauaaugaacaguaugggggacaaaaagaaauauacaauucuacagucuaguuggaagaugaggcauuacugguagggaaauaagaugauaaaaguagucuacagauacguugugcagguaaauuuuucaaauucagaggauaguugccaaagagugaaagaaugaaaguaaaugaaagaaugauacugaaauuucauaccauaauucucuugaaggaaauuucaguaucauucauuuaggauuauuacagugagaaagugugauuaacuuuuguaacauuuguguuucaaauuguagucaaguuguuauguguaacauagaguuuuaguuacagagggaagcuucucugcuuagauacagaaguagccuuagguagagugacuugcuucacuccacccuacacccuagcuaaguucauauaacuagguagugguagaacugggacagaauccgauucucauacuguuucacauauauuuagauuugaguaauauuuauaauucauuuuuuuuuaaauuuuagagaggacuagaagcaaaggcucaguauuugcuaaucauuugcuagaugucagguacuuuauauagauuaucuuauuuaauucuuacaaugauauagugagaaugggcaucauccucauuguugaggaaacugagugauagagcuggaauuuuaauguaaauacuaugcuuuuuauuuugucuugccccuuuccauuacguagaauguacacacauauaugcacccagauaaaacuuaacguacuucagggcuggcaguaacuggcauuuuggacuuaauaguuccccccugucccccauagucauagguugaagccuuaaccaccaauguaacugaauuuggagauacagccuuuaaaagagguaauuaagguuaaaugaggucauaaggguggcuggugaauccuauaggacggguaccuuuauaagaagagguaccaggaguaugagugcaucaagaaaaggucaugugaggacauggugaggaggccuucauuugucagcuaaggagagaggccugaccagaaaccaagcuugccagcacuuugauaguucaauuuccagcaugcagaacugugaaaaaauaauuucuguuguuuaagccacccagacucugguauuucgucauagcagcccaaacugacuaauacauggguaacucuacaucuuuaaaaauggauuuggauuauuuuggaacagauuaaaugcaugucugcugcuugagaaauaagguccucauucuuuuaauuucuuucacugugggagagaaaaucuugccuuacuuuaccucuuucuuuguuagucagugaccuuuaucuuuuuugauuguaccucuguugaaagauggaaagcauauuuaaaugcaugucugauuauuauaguguggaaagauccuacacaugaccaugguagccauggaauauccuauggauaagcuguuacuccagcaaauuuucuguauucaauguguguucauuguuguaacauuuuacuuuaaaaauuucgcuaauacaucugucucaagcuaagggaaagacuuagagaucucccucaccucuuuuaaguguuuuuuguaggaauaacuugcuaaacuggguucauauuagacacuuguguaacgauagaccguaucucaccuauauucuuuucuaucuaaauguugauucauuucucuaauuuuuaaaucuuuuuauuuugagguaauuguagauucauaugcaguuuuaagaaauaagacagaugggccgggcgcaguggcucacuccuguaaucccagcacuuugggaggccgagguggguggaucacagggucaggagaucgagaccauccuggcuaacacggugaaaccccgucucuacuaaaaauacaaaaaaaaaaaaaaauuagcugggcgugguggugggugccugcuacucgggaggcugagacaggagaauggcgugaaccugggaggcagaguuugcagugagccgagaucaugccacugcacuccagccugggcgacagagcgagacucugucucaaaaaaaaagaaaagaaaaaguaauaaguuagagauguacuuguucauccauuuuaccucagugguaacaucuugcauaacuauagugcaguaucaaaaccaggacauugacaucgcuguaauccaccuauuuuguucacauuucaccaguuuuacauauauucauuugugugugugcauguaugugugugugauauauuuaguauuuaguucuaugcaguauuguaacauguaaauuuguauaaucauuaccauacuagagauacagaagaguuucuucaccacuagaaucucucaugcuguguuuuauaaccagagugucuccuuccucuuuccuuauucccugguaacugcuaauuuguucuuuuuuuuuuuuuuuuuuuuuuuuccuguggucauuuaaagaagauuaugcgggcugggugcaauggcucauuccuguaaucucagcacuuugugaggcugaggcaguuggaucgcuugagcccaggaguucaagaccagccugggcaacauggcgaaaccuugucucuacaaaaaaaacaaaaauuagcuguucgugguguugcacaccauagucccagcuauucaggaggcugaggugggaggaucaccugagccuaugagguugaggcugcagugaguuaugauugugccauugcacuccagccugggugacagaaugauaaccugccucaaaauggaaucaaauaguauguaaccuuuugggauuggcauuugucacucagcauaauuugucaaguucguguaaguugaaguaucaauauuuugcccuuuuuucauugcugaauaguaguccaugguguagaugugccacaguuuguuuaaccguucagccauuggggaacauuugggucauuucuaguuuuggguauuauaaaaaaaagcugcuauaaacauuuguauauauguuuuugugugaacauaaguuuucauuucugucaguuaaguccccgagaguacaauuacuggauuguaugauaguugcauguucacuuuuauaagaaauugccagcauuuucuauaauggcuauauauuuuuacauucucaccagcaaugugugaaagauccgguuucucugugucuuaaccagcauuugaugauaucauuuuuuauuuuagccuuucuguuuuuacugauaucucauugugauuuugauuaacauuuuucuaaugucuaauuauauuagucaggguucuccagagagaaucaauaagauacaugcauauauaaaagggaguuuauuagggagaauuggcucaugccauuacaaagucaaaaucccacaauaggucaucugcaagcuagccaaugaaaaaagcugguaccacauccaaguuggaaagccucaaagccaggaaagcugacagucugaggccaaaggccugagacccccagggaggcugcuagccugaguccuggaguccagagaccaaagaaccuggaguuugaugccugagggcaaaagcaaaauaucccucacuagaaggggauggggaacucagcacgcuggcucuguuucucuuacugccugcuuuguucuggcagccgacugcauuggauggugcccacccagagugggucuuacucuccucauucacugacucacaugccagucucuucuguaaacacccucacagacacacccagaaacaaugcuucaccagccaucaaggcaucccucaguccagucaagcugacaccuaauauuaaccaucacaguaaugauguuggaaaaucuuuuucuuucuuucuuuuuuuuuuugacagugucuugcucuguugccuaggcuggaaugcaguggcacaauaauggcucauuacaacuuccaccuuccagguucaagcgauuuuccugccucagccucccaaguagcuagaauuacaggcaccugccaccacgccuggcuaauucuuguauuuuuaguagagacaggguuucaccauguuggccaggccgguccugaacuccugaccucaagugauccaccugccucagccucccaaaaugcugggauuacaagcgugagccaccucgcccagcuugaaaaaucuuuucaugugcuuuuuccaucuguauaccuucuuuggugaaaugucugugucuuuggcccauuuucaaauuggauuuuuuuaaauuguugaguuucaagagguucaacccauauuguaacaugugucagaauuuucuuucuuucuuuuuuuuugagacagagucucacucugucgcccaggcuggaguauggugguccgaucucggcugacugcaaaguccaccuccccaguucaugccauucuccugccucagcaucccgaguagcuggacuaccggcgccugccaccacgccuggcuaauuucuuuuuuuuuuuuugaggcugaauaauguuccauugcauguauauaucaccuuuuguuuacccaguuauccacugaacauuuggguugcuugcaucuuuuggcuaugguucccagugugcacaugguauauaaauaucuguuccagugccugcuuucauuuuggguauauacccaggcauggaauugcugaaucauaugguaauucuguuuuuaauuuuuuaaggaaucaucauacuguuuuccacagugaccacaccauuuuauagucccagcagcaaugcacaaggguuagaauuucucugcauccuugccaacacuuuuuuuuuuuuuuuugagacggaguuucgcucuuguugcccaggcugaagugcaauggcgugaucucgucucacugcaaucucgucucacugcaaucucgucuuacugcaaucuccgccuccugaguucaagugauuauccugccucagcuucccgagugccaacacuuuuuauuuucuauuuucuuaauaauagcuauccuagugggugugaaguaguaacugguuuugauuugcauuuuccuaagauuagugcuguugagcaucuuuucaugugcuuauuggccauuuauauauauaucuuuuuuuugaagaaaugucuguugcccauuuuuguuuuuguuuuuguuuuuuugagacggaggcuuguucuguugcccaggcuggagugcagugacacgaucucggcucacugcaaccuccgccuccuggguuuaagcgauccuccuguuucaaccucccagcuagcugggauuacaggcgcaugccaccacgcccggcaaauuuuuguguuuuuaguagagaugggguuucaccauguuggccaggauggucuugaacuccugaccucaaguaauccaccagucucagccucccaaagugcugggauuacaggugugagccaccgcccccagccuauugccuauuuucgaguugaguuuuuuuguuuucguaggaguucuuuauauguucuugauauuaaucccccaucagcuauaugauuagcaaauauuuuugcccauuccacaggcuacuuuuuaguuuuguugauagugucuuuugaugcauuuaauuuaauuuugaugaauuccagcuuacuuguuuuuuucuuuuguugccuauaaguuuuauuucagucaucaacuaugauuugaaaaccucuggaguagaaggauagucuguuguuuuuaucuacauuucugcuuuucuuauuguuuuuucuucuuucuugguguuucaagauuccuucuuuuauugaagaauuuccuuauucuuuaaagguaugucugcuaguaacaauuuauucguuuuccuuuugccuguaaaugucauuauuucaccauuauuccugaaagauaguuucaccacaaauaagauuuaugguugacaauucuuuucuuucagaaguugaaaaauuuugugccacuuuucuucuguccuuugugguuucagaugauaaaucucuugccacuugaauugguguuccccuauaagguaaugugucuuuucucuguaauugcuuucaaaaucuuuaucuuuguuuucagaaguuuagugauaugucaggguuucuguggguuuaccuguuugagauuugaucacuuccuggaucuguagguuuauguuuuucuccaaauacggauguuuucagccauuauuuuugaauacccuuucaauuccaugcucuuuucuuugggacuccagugauacggaguuagaucuuacguuacugucuuacagauccucaagacuuuuaacuucuuuuuagucauuuuucuuccuguuguucagaugggguaaauucuauugaucuguugguccucaaguucacagauucugucuucugucaucugcuauugagcccauuaaguugaaaaaaauaauuuuuaaauugacaaaaauuguguauguguguuguguacaacagauauuuugauauauguauacauuguggaaugacuaaacugagcuaauuaaccugcguuaccuuacguacucagcauuuuuuuugugugugcugaaaacacaaucguagcaauuuaaaguaugcaguaaauuauuauuauaaacuauggacaccauguuuguaccauagaucucuugaacuuauuccucuuaacugaaauuuaucuccuuugaucaacauuuccucaccuaucuaguaaguuuuguuuuuuuuuuguguuuuuuuuuuuuuugguuguuauuguagcuuguuuuaucaucauuugguugguuuuacaaccuuuuucuuagcugaaauuuucuauuuuuuaaaucuguuuuaaaagaauuuguaauugauuguugaaguguuuuuaaugauagcugauugaaaauuaaaaaccuuuccaacaucuaauacacaucaacauuaacauguuuauuuucuuuuucucauccaaguugugacuuucuugguucuugguaugaugggugaguuuugauuguauguugggcauuuuggcuucuagauaauuuuuaaauaaucacuuuuccccuaaauaugauuaauauauguuuacuauagaaaauuuggagacuauuagaaaauaugaagaaaaaccaauccuuacuuuuacuaccaaagguaauaaucacuguuaaguuuuuguauauuauauauaucuaaaauacaucuguauauaucccuaucccccuaaauauaauuauagcuaacauuuucacauaugagaacauugagauguggaggguuuuagguaacuuucccaagucacagagccuaccaagugauacaaacccaagcuuuugaccccuaagucuauuuaacuacuaugcuacauucccacuucuguuuuucuuccuggaugcuucagaaaaauuguuucaguaggagaaugaaguucuuugaggaggaauuaggguguuauagccaucuuaagggacuuaauacaguguuuauuuuggguaguucaguauuuauggauauucauguacuugcaugcauucuggagguuaucucaggcaauagagaaaugagcuuugauacuucuguguaugcauuuauuuagagauauuuguaucaacaaauaccuccuuaagguugaaggccuuuucuuuuugacagauuuuuaaaucuucuuucaagacaaaugcagaaauaugaaacaacauauaacgaaacccaauuuuuuucuuaucaguguuacaaugaaaugauguuauuugaggaccuauucuauguuguuuucuuaaggcugcaguuucuaagaaccuaucagugaugaagugaggaugcaauuguaguguuuuaauuaaaccauuguuagcuuucuuauuuauugaacagccacgguauaggaauucuuucauacauuaugucacuuaagugacuauagguugcuuucucucucuauauagacagacagguagguaggcagaugguaagcuuaguuguucacucacaucaguuggguuuuaggguggcugccaaagcauggauuuagaagaaauuauuauuaaucacugcauuaaguagugaccauaugaaaauuuaggaauauuuuacugucuuuuaguuccuccuugaugaagaaagcuaauccagguaucuggaguggaacuguucucuacuuagacuuaggggacacugcaaugcuuuauugcuggugguagaagaaaugaaauuucaguuagauuuaguaguucuuuggaaucauguaguaauucuccacauuugucaucauuaguaauuaaaaagaauauaacuauuuguuuguauuuguuuguguuugguuagcacauaaaucugauuaauuucucagggaauuuggaaaaaaagaacacaacccucacacuaacaggaaaucauauccucuaguuaauauuaggauuccugaauaucuuccuuuuguauggucauugagaucaaaaucuuuuuaucaugaagcuguuuuugaaauuuuaacaagugaauaggaaauaaccuaauauuuuuguuuugacauuguuuuuuaagaaccuuaucuaugugauagaauaacauuuaacauuaaaguuagugucagaaaucauacaacuuuuaaagugcugcggagauaaugguaccauuuauuuauuuauuuauuuauuuauuuauuuauuuauuuauuuauuuauuuugagauggagucuuguucugucgccaggcuguagugcaguggugugaucucggcucacugcaaccuccacuucccggguucaagcgauucuucugccucagcuucccaaguagcugggacuacaggcgagugccaccacgcccagcuaauuuuuauauuuuuuaguagagaugggguuucacuauguuggccaggauggucuugauuucuugaccucgugauccuuccuccucggccucccaaagugcugggauuacaggcgugagccaccgcgccuggcaaugaaugguaccuuuuaauuaauuuuuguggaaaugguauuaucuuccuagugcacagggcccuugagagaguacaguggaauaaaaguuuaaauauaauaggagaaaaauuguauuaugcuuugaaugcuaugguaauggcuugugcauagcauuguaguguagauauguggaauuguaaugcaauucucuucuuaacuuuuuauuuaaaaacuuuuuuuuaagauuucagucagucucuuuuucuuuuucuuuuuuuuuuuuuuuuugagacaaagucucgcucugucgccuaggcuggagugcaauggcgugaucuuggcucacugcaacccuucaccucccagguucaagcgauucuucugucucagccuccugaguagcugggaucauaggcgcacaccaccacgcccagcuaauuuuuguauuuuuaauagagaugggauuucgccauguuggccaggcugcucucgaacuccugacccuagguaaucugccugccucagccucccagagugcugggauuacaggucugagccaccgugcccggccagucggucucuuuuucuccuuucccacucuaaccaguuaucuagauuguucuauucuaccuccgaaauagaucuaacaccuuucuuuuauuauuauuauuuugugauggaguuucgcucuguagcccaggcuggagugcaguggcaugaucuuggcucacugaaaccuccaccucccgcuucaagcaauucucaugccucagccucccgaguagcugggauuacaggugcgugccaccaccccuggcuaauuuuuguauuuuuuuaguagagucaggguuucacauguuggcaaggcuggucucgaaugccugaccucaagugauccacucgcauuuggccucccaaaaggaucugacauuucuuuuuuauuuccuuuacuuugauucacacccucauuuucucuuucuucuccuauuagaguggucuguuacuuuuuucccuuuuacugaucucuuccucagccaauugauaacucuuuauuauuggcuuucaaaauguuuaacuucaacccaaguaaaaauuaagaaauuccugauacauuaugacacagagcuuauguguauauuuaaauuaaaaaaaaaacugcaaagguuuaaugaaaaauaaccuuuaaaauuacuacuugugauacaauucuauuuucauuuuaauucuguuauacucuacuuaaaaauuacugguagaaagcaacuaaauugaauuugaaacucccagcaguuugaaaaauugcuuuauuuuacuuucaguagacaaauuuuauacuuucuuaaaauccuuuuguggaucuauuguuuacagaguaguggccuucagauauaauuuugaccaugacucacuaaaagaaauagauuuuacaccugugacccaguauacacauaugcauaaacguauacacacacacacucacauauauauauaccauauauauauacaccauauacauauacaccauauauauauacaccauauacauauacaccauauauaaggaacaccauauauauacauaccauauauauacaccauauauauacauaccauauauacaccauauauauaccauauauacacaccauauauauaccauauauauacaccauauauauaccauauauauacacaccauauauauaccccauguauauacacaccauauauacacaccauauauauacacaccauauauauacacaccauauauauacacaccauauauauauacacaccguauauauacacuguauauauacacaccauauauauauacacaccguauauacacaccauauauauacacaccguauauauacacaccauauauauaccguauauauacacaccauauacaccguauauauacacaccauauauauacaccauauauacacaccauauauauacaccauauauacacaccauauauauaccauauauacaccauauauauaccauauauacacacaccauauauauaccauauauacacaccauauauacaccauauauacacaccauauauauacaccauauauauaccauauauauacacaccauauauauacacaccauauauauacaccauauauauacccaccauauauauaccauauauauaccauauauacacaccauauauauacaccauacauauacacaccauauauauacaccauacauauacacgccauauauauaccauacauauacacgccauagauauaccauauauauacacgccauagauauacaccauauauguacacgccauagauauauaccauauauguacacgccauagauauaccauuauguacacgccauagauauaccauuauguacacgccauagauauaccauauauguacacgccauauauauacacaccauauauauaccauauauacacacaccauauauauaccauauauacacacaccauauauauaccauauauacacacaccauauauauaccauauauacacacaccauauauauaccauauauacacacaccauauauauauaacauauauauaccauauauacacacaccauauauauaccauauauacacacaccauauauauaccauauauacacacaccauauauauauaccauauauauaccauauauacacacaccauauauauaccauauauacacacaccauauauauauaccauauauacacacaccauauauauaccauauauauacacaccauauauauauaccauauauauacacaccauauauauauauauaccauauauauauaccagaagcaauuuuaugccucuccauuuacuauuucuucuguugggacacguuucucccuaccuugauuauaugacagacuuucauuuauucuucugaauacagcugggacauucuugaaguugauguaauaugacaaaaaauaaagauuccuucucaaacaguggcagcaacgaugucaucaaaccaacuuggaaagaauuguuuucucagagaauuaaaccacacgaaaucaauuaaaucagugugcaaugaauuacacaaguuuucugguuagaaagaccugacaguaccugcuugguaauacuggcuuauuuaaauaauagggauuguagcaaacgauguggucauaauggacucauguaaaauggagccuuauuaaggguuagcuugucaggugucaucuaaguacaagugagugggcuuuuuuuagcccaaggauggaaucuguuucugguggaguuauucuuguuauuauguaaauguuuuuauuggauauaggcuuuuuuuuggguccagauugcauguucaacuuuaccccaaguauuuguguuggaaaauuugaaauuugcagaaaaguugcaagaauacugagcaacuuuauauuuugucacauuuuaguuugucccuuucucuuuauacacacauguauauauuacuuuugcugaacuguuuaaaaguaaguugcagagaucuuguucuuuuccauugaaauacuuuaucauguauuucccaagaauaaggacaauagccuacaaaaccaaauauaaugaauuuaacauuaauguauuauucauauaucgucaguuauuccuauagugucguuuauauuugucuguuuuaaugaacugcauuuaauuguuaugucuuuuuugucuccuuuaaucuagaacaguccuuuuugcuuuuuauuucuuuuguaacauuaacauuuuugaagaguuuaggauaguucugcagaaugugucucaauuuguauuugauuguuuucucauaguuacacuuagauuaaccauuacuggcagagauaugccauaggucaugaguucucaguacauaagggcacaugacgucaauuauccuauugaugauguaccuaaguuuggacuugguuaagguggguugcaccagauuuugcuauuaugaaaaauaccuuucccuuuauaauuaauaaauaauaaguacccauugguuuuaauagccguugauuauuuuuaccugaaucauuuauuuucuuguaaugauacuguaaaauggugguuuuucccucuauuuguaauuucguugaaauuuauuaguuggcaaucuucauuagggaaucuuaggauuacaguuuggcuucccacuuaguaggcuuguaggggagauuaggcugggcagagauacaugcaggcaugcauguauuuuauuuuauuauuauuauuuuuucagacaaggucuugcuuuguuucucagguuggagugcagugguguaaucacuguucacugcagccucaaccucccagguucaagcgaucuucccaccucagccuuccuauuaacuaagacuacagaugcaugccaccaugcccagcuaaugcuuuauuuuuuguauagacagguucucaccaauuucccaggcucgucuugaacucuuggacuugagugauccucccuccuuggccucccaaagugcugggaucacaggcaugagccaccgugccuggcuuaauuuuguuguuguuguuaauagauaaauuguccuugugguuucuauauuagucacuuucgagcuuuguuaaauggaucaacaaccuuauaucccaucaacucuuaauaguugacucacuugaguuuaaguuauauauccuggagcagucaucuugacuuuugcuauuuaaugauguuucuugacaguuagcaaguuauauagcuuguucugggugaaacccuucugccuugcaucuuuacccauuuguauuccauuuuuacagugauuuauuucaaggcaaugaggacaaggaggaugcaaaaucaaaaaaggcauuggauuuaaugguuaaaggugguguauaagggacaggaaugcaguuugaguaaaauggugaauacuucuagauaggcacaaaaauuuuauuuccccuaguucacuuuuuaaaaauuaauaaacuuuauuuuuuagagcaguuuuagcuuuauggcaaaauugaggggaaaguagaguucccauauuccacccccucuuuuucccacuguugacauccagcacacuggcacauuuguuuccaguggugaacuuacauuagcauauuauugucacccaguguucauaguuuacauuaggguuuauucuuggcauuguacauucuauagguuuucacaaauguuuaaugacauguaucccacauuguggugucauacaaaauaguuucauugccuaaaaauccuguuuauuuugucuguucauucuuccuucccccuuagccccugucagucacuaaucuuuuuacugucuccauaguuuuaccuucuccaggauguuguauagauggaauuguacaguauguagccuuuucacauuggcuucuuucacuaaauaacaugcauuuaggauucauucuuucuuuccaugguuugauagcuaauuucuuuuuuugucugaaugcaccauaauuuauccagucagcuaguggugguuuguggauuuuggcaauuaugaauaaaggugcuuauaaacauuuguaugcagguuuuuuuguggccagaaguuuucaauuuauugggauaaauaacaagaagccugauugcuggauaguauaguaaaaguauguuuuggaagaaacugccaaacugucuuccauaguggcugcaccauuuugcauucccaccuguagugagugagaguuccuguugcucuacauucuugucagcauuugauauugccagauuuuuggauuuuggccauuguaaaagguguauagugauaucuuguuugaauaugcuguuuucuaaucacauaugaugauauauaaugguuuggcuaugugacuccucuagaucuguaguuauggccaggguggugacucauaccuauaaucccagcacuuugggaggcugaggugggaggauugcuugaggccaggaguuugagaccagcuuggccaacaugagacugcgacucugucucuacaaaaagaaaaaauuagccagaugguggucagcacaccugugguuccagcuacucaggagaccgaguggggaggaucacuuaagccugagaggccaaggcugcagugagcuaugauugugccacggcacuccuaccugggcaacagggugagacccugucuccuaaauaaauaaauaaaucucauguugaaauguaauuccuaauguuggaggugggaccuggugagagggguuugggucaugggggaggaucccucauggcuugcugccaucuuccugauauugaguuuguuuucacgaggucugguuguuguaaaguguggcaccuugcccgcuacucacucuugcucugcuuucaccaaacaucaugugauauguuuguucccgcuuugccuuccaccaugaguaaaagcucccugagccuacccagaagcugagcagaugcugacaccaugcuuccuacacagccugcagaaccaugagccaguuaaaccacuuauaaauuacccaggcucagguauuucuuuauagccaugcaagaauggucuaaugcauaugauauugaacaucuuuucauguguuuauuugccaucuuuauaucuucuuuggugagaugucuguucaggucuuuugcccauuuuaaaaucagguuuguuuucuuauuguugugaagaguucuuuguauauuuuuggauaacaguccuuuaccagaugugucuuuugaaaauauuuuucucccagucuaugguuugucuuuucauuuucuugacaguugcuuuuugcagagcagaaguuuuuaauuuuaaugaaauccagcuuauucguuuuuucuuucauggauugugacuuuugugucugagaaggcaucaccauagccaaggucauuagauuuucuuuuuuguuauugucuaggaguuuuauaguuuugcauuuuaauuucggucugugauccauuuugaguuaaauuuugugaaggcuguaaggugaguguuuacauucuuuuuuuuuuuuuuuuugucauguggaugucuaguugugccagcacuguuuguuaaaaagucugucuuugauccauaccuuugcucuuuuuucaaagaucaauugauuauauuuauuugggucuguuucuggguuuccuguuccguuccauugauuuauuuguccuuuucugaaauaccacacuaucuugguuacuauagcauuauaauaagucuaguagugucaaucccuccgacuuuuucuuucaauguuauguuggcuauucuaggucuuuuaccucuccauaaaaacuuuagaauccguuuguugauauccacaaaauaauugcugggauauugauuggaauugugccaaaucuguacgucaaguugggaagaacagacauguugauauugagucuuauucaugaacuuggaguaucucugcauuuauuuaguucuuuguuaucuuccaucauaguuuuguaguuuuucuuuuauagauccuguacauauuuuguuagaauuauaccuaaguauuucauuuuuugguugcuaauguaaaugguaauguguuuuaaguuucuuuuguacaaacaggaaagccaguggcuuuccuuguauucugcaaccuugcuuguuaguuccaugagguuuuuugucaguucuuuagaauuuucuaccuagacaauccugucaucugagaacaaagacaguauuauuucuucuuuuccaaucaguauaccuuuuuccuuuuucuguuuuacugcauuagcuaggacuuugaguaugauuuugaaaaacagugguaagaggagguguccuugcauuuuuccccaucuuggugggaaagcuuugacauucucaccauuaaguaugguguuagcuguagauuuuuugguagauuuuuuuuuuuuaucaaguugaggaaguucccuucuauuccuaauuugcucagcguuuuagucaugauuggguauuggauaccgucaaauggauuuucugcaucuauuaauaugaucaugugauuuuucuucacccugacgugauugauuacauugauuuuuaaaaauguugagccagucuugguaaauacugcuugaucaugguauguaaguacauuguuggauuuaauuugcuaauauuuuguugaggauguucgcaucuauguucauaagagauuggucuguaguuuucuuuucuuguaaugucuuugucugguuuugguauuagguuaguauuguccucacagaaugacuuaggaaguaacugcuaugucucugaaagagacuguagagaauugguauucuuuucuuuauauguuuauuagaauucaccagugaacccaucuggauuugguucccucuguuucugaaaguuaguuauugauucaauuuuuuuaauagauguaggucuauucaagauuuuuuuuucuacugugaguuuuggcagauuauguuuuuuaaguaguugcuccauuucauuuagcuuugcaaauuugugggcguagauuuauuuacaauauuaguuuauuaucuuuuuaaugacuuuggggucaguagcgauuaguaaagaucuucucuuucaguucugauauuaguaauuugucuucugucuuuuuuuguaagucuggcuagaggcuuaucaguuuuauugauuuuuucagaaaaguuacuuuuggguuuguuaauuuacucuauugauuuccuguuaucaauuccauugauuuuugcuguaauuucuauauuucucuuuaucugcuuacuuuggaguuaauuugcuuuucuuucuugcuuucuaugaugaaguuuagauuauuauuauuauauacaaauuuuauuuaagagacagggucucacuauguggcucaagcuggagugcaguggcuauucccaggugcaaucccacuacugaucuguguuuugaccugcucuguuuccaaccugggugguucaccccuccuuaggcaaccuggugguguccuguucccagggguguugauaccaaacuaaucguggagguuuacugggcauaauguacuacaguccagaacuucuggauucuauccauuuuucugccuucaccucccagguaacugggacuacaagugugugccagugcuccuagcugaagcucugauuacugauuuuuuaucuuucuuacaugugcauucaaacuauaaguuuuccuccaagcacugcuuuugcugcaucccagaaguguuaaauuguauuuucauuuuaauuuaaaguauuuuaaaauugcucuucacauuucucuuugauuaauguguuuauucagaaguacuuuggaauuuuccuauguuuuguuauuuauuucuaguuuaauucuguggucugauaguagacauuauaugauuucuauacuuauaaauuuguuaagguguguuauuacccagaauguggucuauguugguaaauauuucauucgagcuuggagagaaugugcagucugcuguuguuggaugaaguagucuauagaugucaguuauauccaguuaauugaaagugcugcugaguuaaacuauaucuuuacugauuuauugcuggcuggaucugcccauuccugauagagccauguugaaaucucaacucuaauagugcauuuauguauuuccucuugaaguucugguuuuuuuuuauuuuuacucuucauuguuaggcauauauauauuaaggaucauugggucuucuugagguauugaucccuuuaucauuacuuaaugccucucuuuaucccugguaacuuuccaugcucugaaguuggcuccgucugaaauuaauauagcugcucccacuuucuucugauuagcguuagcgugguguaucuuucuccaucccuuugcuuuuaaucuguauguguuuuuauauuuaaaaugaguuucuuguucauauaguaggaucuuguuuuuuggucuacuuugacagugucuuuuaacugguauauuagacuugauguuuaaagugguuauugauauaguuaaauuaauauucaccauauuucuuacgauuuucuauuuguugcccuguuucuuuguaacuuuuuguuaugcacuuuuucugucuuuugugauuuaauuauuuuauaugauuucauuuuucucucauuuuugagcacaccaguuauauauauauauuuauuuuauuuuauuuauuuauuuauuuuuuugagacacuguaucacccaggcuggaguacaguggcgugauguugucucacugcuccaucucccuggcucaagugauccucccaccucagccucuuaaguagcuggaacgauagaugcacaccaccaugccuggcuaguuacuguuugugcuuuuuuuuguagagauaggguuuugccauguugcccaggccggucucaaauuccugggcuaaagcaauccacucaccuuggccucccaaagugcugggauuauaggcaugagccaccacgccuguccucuaguuuugguuuuuuuuuuuugagauggagucuugcucugucauccaggcuggaaugcaguguuaccaucucugcucacagcaaccuccaccuuccauauucaagcaguucuccugccucagccucugggguagcugggauuacaggcgugcgccaccacgcccagcuaauuuuuguguuuuuaguagagauggaguuuugccauguuggccaggcugguguugaauuccugaccucgagugaucugccugccuuggccucccaaaguguugggauuacaggugugagccacuacaaccagccuuuuuuuuuuucuuuuuuuuccuaacuuaaguguuugcccuggagcuugcaauauacauuuacaguuuuccaagcacauugucaaauaguacuguauugcuucauggguuguguaaguacuuuauaauaacaaaauauuccuguuuccuugcuucuguccuuuucuaucuugucauucauuucacuuauacauaggcauacgcaagcagauacaucauugcuauuauuuugaacuguuaccuuuuagcugaauuaaaaauaagaaaaauaaaaguuuuuauuuugccuucacuuguucucucauguucuuccugaguuucugaccuauaucauuauccucuuucaugaaauuauuuuaaugugucuugcaaggcaggucuacuggcaacacaagucuucaauuuuuguuugucugagaaugucuuuauguuucuuucacucuagaaggauaguuucacaugguauaaauuuuuagguucauguuuuuuuucucucaacacuuuaguuuaauuucauucuacucuccuguuugcauuguuucuaaggagaagcuggucuucuguaggcaagguguuuuuugccucugguuucuuucaagauuuuuuucuuugcuuuugauuuucugaagcuugaauaugauaugcuuagauuuuuaaaaauuauuuuuagguuuuuaggggccucagucuuaauguuaucugaguuuuauggaucugugguuuggugucugauaugaacuuggaaauucuuagucauuauuguuuccuuguguuaccaguguauuuaaguuacaccuuuuuuaguuuccuacaguucuugaauguucuacucuuucuuuuuccucucuuuuuuuucuuugcuuuucaguuuuggaaguaguuucuguuguuagacccuuaagcucagagaugcuuuccuuagcuauguucagucuacuaaugaagccauuaaagacauucuucauuucuguuauguugcuuuugauuucuaacauuucuuuuuauccuuucuuagaauuuccguuucucugcuuacauugucuauguauuugcauauugucuaccuuuuucauaaagcaccuagcauauuaaucauaguuuuaaaaaauucccagucugguaacuccagaauuccugacaugucuguuuuugauacuugcucugucucuucaagcuguuuuuugccuuuuauuaugucuuguaauuuuuuauugaaagguauacaugauguacuagguaaaaggaacugcugcaaauaggccuuuagugauguaguuauaagggaggcauuguguaguucuaguauuaggucccaguuuuuuggugaaccugugcuccuggacugugaacauaaccauuguuucucagucccccacccuuaucccugucaccuuuaggugggacagaaugguuagaaaggacuggaauuugguauuucccuucccucuugugaaaggcugaagugaacuggaguuguuuacaguacuucuuuacccacagguagguuaggcucugguaaauuaguuucuguucaaggcaggccuuguuaagaacugauugcucuggcguauuucaaaauuguucuuuuuuccuucccccuaccagaagcacaaagggauuuuucucugauauuuacuguaagggcauaguagagcuccuggagguaaaauucacaagagugucagggccucacaugacuggauccuccuggaguuuuuaauugucauuuguuggcacugagucuccagcaauuugucauuauaguugaggcuuucuuacccuggcacugguucccaaggaaguuucugcuuguggguuucugcucugaugacuugagauuuuucucuaucugccuaccugucucucaauuuuggggaaccgugguuugcccugugaccucacuucucugaaggaucuaacuacagcuauugguuuuucaguuugcuuagcuuuuuacuuguuaggauggaguggugacuuuuaaucuucuuacauguaaagaaggaacaggaggcugggcacgguggcucacaccuguaaucccagcacuuugggaggccgaggcggguggaucacgaggucaggagaucgagaccauccuggcuaacauggugaaacccugucucuacuaaaaauacaaaaaauuagccgggcaugguggcgggugccuguagucccagcuacucgggaggcugaggcaggagaauggugugagccagggaggcggagcuugcagugagccuagaucguacaugccacugcacuccagccuggacgacagagcgagacucugucucaaaaaaaaaaaaaaaaagaagaagaaacaggaaggaacaggaaacugacaggcagcagcuuaaagccuguuuaaagguuacaaguuuuaaagggguuaaaaagagauugguuugugggaauucggaggcuacauccuuucagagaaugaguaguuagaggggauagcaaauuaaagggaguaguuuuuucagaauagcaaaagauaauauuugauaauguuuuuuuauucuuaauaguaaauauuuagcuauuuuauaaaucaaucauugagguuggauuuuuuguuuuuacccuaguguauuugaaaguaaaugaugcuuuauuuucaauauuugcugauguauuuaaucaaaaccuagagaauugagauagacauuguaucagaagaaagcaguuuugaacaaagagagcgaauuacuagccaguuaacaagugucagcuguuuuauaagcauggcauaacacuuccuaaauugugcacugcauuguucaguuaaaggaauuggcguucugugacuuuuugacaguuaaauaauuugagaacuucugcauuuugggccugugcucuuggaaauccagaauguacauuaacuuauuuaugccuaguguuccauuaauggaacgcuaagcaucugggaguucuuuauauccuacugcucaaggucaucgccaaggucugauuuuucacccucaaaaaauugcaaccuuagacauaaauacaggaguccuaugagucauuaauauacuaaacaaacuuucuuguuuaacucugcuuuuucuaaacuuacaugcuuagugaucauucuuugcagggcguguuuugagaaacauaguaauagcaaguaguuaaguuucuaucuaccugguguucacagugggaguaguauagaggaagaacccaaguuuagccuuuggaaaaccugaguuugugguuuuuaaugcuuuuagugaaucacuauauuggaaaaguuaauuuaaguuccucaugauuguuuccuuuuguaaaauauaguaacauuucuccauuucuaauucacagugaugcagauguuuuauaguuaccaaaaaggcuauaauaaaguacuuacauauaagguuuguauaugguucucuuuucuuuuuuauugucuauauguaagguacacaacauaauguuuugauaugcauauauguagugaaguaauuacuacagucaaguaaauuaacauaucccgcaucucccauaguuaaccguuugugugugugugugugugugugugugguaagagugccuaaaaaauauggaaugcuucacaaauuugcaugucauccuugagcaggggucauauugaucuuuucucuauuaucaucccaauuuuuaguauaugugcugcagaagugaguacuguauaugguucuuacaaagaaggggaacguuugacaccugcuuucuggugguaggugugauguugaugugaauuguuccaggagucagaaaccuauauagauguugaaagaauaaaucaguaugcaagggaaugguguguuaacauuauguagaggcaacagugcuaaggaguuauacuauuuucuuauaauuuuuuuccuuuggacacuauaauauguggugaagggaugaccaauaaaacaagaauaauagauauuuaguguugcuuauuaagaguuaagcggagggcugggugcaguuggcucaugccuguaaucccagcacuuugaggggccaaaggagagaggauugcaugagcccgggaguuagagaccaaaccgagcaacauagggagacccugucucuacaaaaaauaaaaauaaaaaguuuagcagggcauggugguagcacacuuguggucccagcuacuugggaggcugggguaggaaguucacgugagcccaagugguugagcuugcagugaguucugaucuugccacugcacucucacucgcuuggaugaccaagcgagauaugucucauaagcugggcaggguggccucugcguguaauccuagcuacuugggaggcugaggugggagaacugcuugaggccaggaauuugagaccgcccuuaacaaccuaacaagacccugucucaaaaaaauauuaaaauaaaaagaguuagauggauuacaagaaagcuucccuagcugguaaguuuauccugcuuacuaaugacagaaauauaguugaaacaugauagaauaaaguuuuggaugaaaucuuaugcaauuauuuauaagguaauaucuacaauuuaauuauuuuguuguaaggauguuaaaaugaguuuuagaauaaugcauacuauuagaagagcuuuuuauaugaaaagaaaauauucagauuuuuuguuauugaaaaaguuuaaaagaugauuauaugauuaaaauuuacauaguuaacgaacagagaaaaugaaaaauggugacaaaauccugagagguauaaaacuacauaugccaaagaggcagaugcaugaauuucuguccugucucugaccuuagugggcaugaggcauuagucacggaaaggcagaaaagaugaggcaggguuagguccuggcugugagucacccauugacucagcuguuaguaccaaccacuuagucuuaggcugcugaaugggacauaagugaauuuucaaguuaccacuguuguggccucuacaaacauuuggcaguauugggggguuaagggagauuaaguccaagacaauauaacagaugagggagaggguaacagcuggacaacacauuguuauaaaguguuuaguguagauauaauuuugacugucuaauguuuuauuuauguauauguauaauuacauauaauauauaugcacauacuaauuuuaaagcaugcucccuuuaguguugaaaugaaaguuuuaguauagaguuuuucuguauuuagaauuacuuuuuuucccuuggguauacuuuuucuugaaguauaacacauauaaagcauaguaucuucaguguucagcacaaugaauuuuaacaaguggguguaccuguguaauccauacuuaaagaaccccagaauauuaucagcaucuuagaugucuuuuugugccuacuuucugccuaauacacacaccaccucuuccugaaaaacaaaauucuaacuucuuguauccuagauuauuucugacuuuuugaguuuuauauaauaaaauugaaucacauacagguugaguuucccuuaaugcuuaggaccagaaguguuucagauuucguauuuuuggggggcuuuauuugcauuauaccaguugagcauccuuaaucugaaauccagauauuccaaugagcauuuccuuugugugucauggugguccucaaaguuucagauuuuggagcauuuuggauuucaauuuucagauuagggauacucaaccuuuacuaucuauucuuuuguguguuacuuuguuauguuuaugagauuuauucauguuguugcaugugacacuauuucacucaucuccauugcuuguguuacauugugacuauaccaacaguguauuauccuuuucuacuagugauggacaugacauuuagggugugucuaguuugacuauuacagauagcauugcuaugaauuuucugauaaugacuuuuaaugaacauguauagacauuuauguuauacaccuaggauuagaauugcugggucauaggauguucauauaauaagcuugguagguauugcugaauaguuuugcaaaguguuuguacccauuuaaauucugaguagcaacaugugagaauuucaguugcucuacauucuugugaacauuuaguauuguuuacccuuuucauuguagugauguagguggguuggugguguaauagcucuugugguuuuaauuuuuauuuucuugaugugaugacuaauggaaguguguauuuuuucauauguucauuggucauuucuauaaccucuuucaugaagagguuauaguucaagucuucaagucuucuguccaguuuucuauugguuuuucuuuuuuuguauuuauuucugguuauucucugucuuggcuaugagucuuuugaugaguauauaucuuauagaaaucuucaauuucgcacuguuguuuuuuuaacagaaguuaauuuuaucaguuuuuucucucuuuguggucgaaguguaacacacauaaagcauaguauucuauauacuauaguauacuauacuguauaguauaguauacuauacuaaagcauaguauucuaaguguucaacgcaaugaguuuuaacaaguggauguaccuguguaauccauacuuaaagaaccccagaauauuaucagcauccuagauaucuuuuugggccugcuuucugccuaauacgcacaccaccucuucccgaauaaacagaauucuaacuucucacaucccagauuauuucugacuuuuucagcuuuauauaauaacauugaaucauaaacagguugagguuuuuggagucauguuuaagaaaucuuugcaugcucgaaggagaugaacguauuugccuguguuuuuuucuagaugcuuuauugucuuuuucuuuuagacguacauauggaauugauuuuugugaauggagcaaggaagaggucaagauucauuuaaaaacaauguccauaucuaguugacccauuuccgucaaguaaagagcucauauuuuucauacaugugugaguuuguuacaucucacuucugucccauuagucuacuugucuaucuuuacauuaauucucaauguauaauagcacgacuaauuguucuucaguaggaccugucucuuuuucacuagugaaauugauacuuugugaccuuuuucauuuguucagucuucuuccagucuaucaauuuuguuaaucuuuccaagaacuaauuuuucauuuuuuuuccugaagucuuacguuguaccuuugcuuuugauuucauuaauuguguccuauuuuuuuuuucugucuuuucagguuuaacuuuuugucuuuucuaauuucuugagguagauacuuaaauaauucuucucagucuucuuuuuuaauauaagcauuuaagguuacagauuucccuucaagcauaacuucagcuacgugucacaaauuguuauaugaccugucugcauuugauuucuucacuagcauauugugaagacauauuuccacauaaaugucaacuuuuacaguuuuucuagggguuaguaauuuuuugauuuaguucccuugagagaacauacucugaaugaauucagucauuugaaaugaggcucgcuuuuugauucagcauaugguuucagauuaauguucuauguucacuugaaagguauauauauauaauucauauauauaauucauaauucuagauaugcauacaccaauuucuaaugaauugauuacuguauuauuacgaaaugucuguuaucuuugauacuucuugucuuuuuuuuuuuuuuuuuugaggcagaguuuugcucuugucgcccaagcuggaggcgcgaucucggcucacugcaaacugcaccuccuggguucaagugauucuccugccucagccucccaaguagcugggaccacaggcgcccaccacuacaccuggcuaauuuugguauuuuuaguagagacagaguuucaccauguugaccauagcuggugucaaacuccugaccucuggugauccuccugccucagccucccaaaguuuugggauuacaggcaugagccacugcgcccagcugauacuucuugucuuaaaaucuaguuugucugacaucaguuuucuuuugauuagugcuagugugguaaagcauuuuguauucuucuacuuucaacauuucuguauucuuacauuuaagauacaucucuuauaaguggguuuuauuguuucauauagccugacaucuuagucuuuuagugauuguccuaaagauuacaacauguaucauugacuuauuacagucuacugaaaauauuuacuuuuacuauuucccuaacaauucuaggaacuuagaacaucugaacuucacuuauccuucugcuuuuugcauuauugcucugcauguuuauuauacacuuuuuuuuuuuuuuugacauggagucucacucuguugcccaggccggaguacagugcuacaaucucggcucacugcaaccuccgacuccuggguucaugcaguucuccugccucagccucccaaguggcugggauuacaggugugugcccccauacccagcuaauuuuuguguuuuuaguagagaugagguuucaccauguuggggaggcuggucuugaacuccugaccucaagugauccacccgcaucugccucccaaagugcugggauuguaggcauuagccaucgugccggccuauuguacacauuuuaauauucauuagauauuacugcuuuguacagucaauguuuguuuacacauguauuuacucuuuaugaugcucuucacuuuaugcugcauuuccauucuuuccuguagguuaggaacuuuuuaacuuuuuuuuuuggccuguguaacuucuuuuaguccuuuuuuuuuuuuuuuuuuuuuuugguaaacgucaguugucaaauauacuuuguauuuaucugaaaauguacuuguuuuuguuuuugaaggauauuguuucugugcauuagauucuagauucacaguuacuuucuuucagaaauuugaagauauuccauucucucugcuuuccaguauuuuuguugcaaaguuagcaaaaauuuuuuaucuguuucuuugaauauaaugucuuucuguuuugacuacuuuuaagauuuaguuuugccaaagaacgaaacuggaggcaucaugcuacccaacuucaagcuauaccacagagcuccuguaaccaaaauaacaugguacugguacaagaacagagacauacaccgauggaacggaauagagaaccuggaaauaagaccucacaccuacaacuaucugauuuuugacaaacuugacaaaaacaagcaauggggaaaggacuauuaaauggugcugggauaacuggcuagccauaugcagguugauugaaacuagacccuuuccuuacaccauaugcaaaaauuaagaugaaauaaaacuaaaauauaacaccccauacuauaaaaacccuggaagacaacauaggcaguaccauucaggacauaggccugggcaaaguuucaugaggaagauggcaaaagcaauugcaacaaaagcaaaaauuggcaaaugggauccaguuaaaugaaagagcuucugcacagcaaaaguaacuaucaacagaguaaacagacaacccacagaaugggagaaaauuuuugcaaacuacauaucugacagaggucuaauauccagcaucuagaagaacuuaaaacacauuuacgaggaaaagaauccauuaaaaugugggcaaaggacaugaagagacauguuucaaaagaagacguacuugcgggcaagaaucagaugaaauaaagcucaacaucacugaucauuagagagauguaaaucaaagccacaaugacaccagucagcauggguguuauuaagaagucagaaaaucacagaugcuggcgagguuguggagaaaaaggaaugcuuauacgcaguuggugggaguguaaauuaguucaacuguuguggaagacuguguggaaauuccucaaagaucuaaagauagaaauaccauucaacccauaaaucucauuaguggguauauaaccaaaggaauauaaaucacucuauuauaaagacacaugcacauguauguucauugcagcacucuucacgguagcagagacauggaaucagucuaaaugccugucaauaauagacuggauaaagaaaaugugguacauauauaccauggaauacuaugcagccauuaaaaagaacaagauuauguccuuugcggggacauggaugaagguggaagccauuauccucagcaaacuaaugcaggaagagaaaagucaaauacugcaugcucucacuuauaagugggagcugaaugaucugaacacauagaggggaacaacacacacuggggccuaauugaggguggagggugguaggagggagaggaccaggaaaaaugacuaauagguaccaggcuuaauaccugggugaugaaaugaucuguacaauagacucccaugacacacauuuacuuauguaacaauccugcacauguaccccugaacuuaaaaguugaaaaaaaaaauucagucuugccuuugguuuuuagcauuuuuacuaugauaugccuagauguggccuuuuuuuuaagaaaaaaagaaaaaucuugcugggguauauagaaugcuugaaucuuugccuuaacauuuuucauugaguuuggaagauucuugaccauuuuuucuucauacuuugcuuuuguucuauucucuauugccuccuuucucguacuguacauguaugucugcguacccuccgccaccuccccuuuuuuugagacagggucucacucugucacccagacuggagugcaaugguacgaucauagcuuacugcauacuugaacuccugggcucaagcaguccucuugccucagccuccugaguagcuggggacuauaggugugcgccacugugugcagcguauuuguuuuagaaaaccuuuuuuguagaguugggggucuugcuuuguuguccaggcugguauugaacuccuggcuucaaggauccucccucgucagccuccugaaguguugggauaacaggugugagccacuuugcccagcccguuagucauuuuuuaaaaaacgaugucccauucaucuuuuguauucuuuucuguauuuucuuuuuuucugcauuacgguuugacagguauaacuuuucuguauuuucuguccuuguuuucuuuuuaugcucuaguaaguguauuuucuaugaaacuuugcaaauuauuagcuucuuaaaaauaugccuaaucugaggcaggagaauggcgucaacccgggaggcggagcuugcagugagccgagaucgugccacugcacuccagccugggcaacagagcgaaacucugucucaaaacaacaacaacaacaacaacaacaacaacacaaaacugccuaaucugcuguuaauauuauauuuagcucuuaauuuuacaaauuugauuacuuuuuaaauauucaaauuuuaucauuaaauuccaucuuuauuuuguguuuuccuguauuuucuugaauaacuguuauagccuucugucuguaauuuuaaaauuuauuccccuuugggucugacauugauaauuugugacuuuuucuucuuugaucagucuuaacaaaauguugacuuuaauagucucuccaagaaccaacuuuuguuuuuuuccugaaguuuuauaucuuuguuucauugauuuacuuguuugucuucuuguauacucucucggcgugcguuacauuuuaauuaaaugccagacauuguguuugacaauuuuauagguuaucugaaugaucauuugcuguagaggauggacggcuuagccacuccuguguuaggcagauagaaugcaguuagaucaccuuaaucacaaaacuuuugaauacugcaguuugcuaugcagucuuuccuuagcuucuuaucuguguagcuucacaauucaguagauaucgcuggagggaaauaguuaagccugugguucaguucucuguuucuuuuuuaugaccagaauccuggcccuucaagucucuuaauauuugucucaccagcuuugugagacuguugaaaguucugcuggauuguuuuccuccugagaauucaugcaaaagacccagacagaagaccugggucuuuugcaugaauucucagccucuugcuuugugaccacaauaugcaaauaaauaguuugagagaaaaaguggcagaguggcugcugaauggcaccuucuuuaggauucuauuuguuuugaaauguugguuccuuaaguucugauugccuccauauugagcucuuggaugauuuaaacagacugaucuuuuuauuuuuuauuuuuuguguuuuauuugucuuuucuagcaguucuugauuggagauuauucugcugcaaguaaugugacaaguauuauaacuauuauuaaaaaacaaaauaaugaacaauauaggaaaaagucuuuacucccucauaccuccauaaucucacuguucuugguaguaaccauugcuguuguguauauauauguauaauguacaugcauuuguauaacacauaaguauacguuuaccuauguguaacauacaguaauguuagcauaaugacauuuuggucaguccuauaggauuauaaugccauauuuuuauugugucuuuucuguauuuagauauguuuagauacacaaauaccacugugugaaaauugccuauaguauucaguauagcaauaugcuguacagguugguagccuagaaacaauaugcuauaccauguguaguaggccauggcaguuagauuuguguauguauacuuuaugaugucugcacaaugaugaaauugccugaagauaaauuucuuagaauguaucccugucguuaagcaaugcauaagauuaaguuuucuaauaggcaauguauauuuucacagaggggaaaaauacaacauauuaaaaaagguacucuuuaauuaaaaagaucccuuucugccacuggcucucaguuucccaguuagacuuucuagggucaauaccaauucuguauauauugguuuauuuaagggaugacauuuuuagaaccugucuuaucccaggcacuauuuuaggugguuaggauacaugaauaaacagauuaagaugacuguugcucuguagguuauauuuugcagagaggagacauacaauaaauaugauacauacauaaauaguauagaauucuagaagguaguaagugcuauggcaaaaagaaaagagcaaucagacaggauaguagggcacuggagaggagaaguugccauuuuaaauaggguagucaguauaggacucauugagugacauuuuugugcaaagacuugaagauaaguauaugguaauacacacaguguguuuguguacuucugaauguuuaaacugccuugcucuuuuaaguaaccacauaguuuucuauuggauguacauaauuuauuuacucuuuagugauuaaguuuuaucuagucuuaugauacuguaaacagccacagugaugauccuuucuuguguuaugugagcacaugcacaucuuguauuuugccugcuuucauauauuuuguacugucaaaucucagucuuuguauauuucuuugauuuuugguuuuuguuuuggcuuuuaagcaaagauuaucauauaucaguauuuuauauauaaaccuauaguuuuuauaguauuaaaaaaauacuuuaacuuguuuaacauuuaauuuggcaugguuugggauucuaaguugauaacuuuccaagcaucuuacugaauguuguaucaguauuuguugaauauuuuuugugauaugcuuucuauuauacauuaaauuuuuauaugugauaagauccuuuuuuaggauuuauguuuaugugcuaguugaaagcucuucuacuuguugggugacuuggaggcagggcuuuaccaggaaaaagaagaaagagagguaauauaauguuuugacuacaggaaagacuucuguuguugguuggggcaaguaaugucaagcaguuuguugcuuuugaaaaucaauugacugcuuugagguugauuucuuugugaauaacuuuaaguuauauguaagacauuccuaaauuucugaaauuguguuaaagaugaggaucauagcaaacuaucaagaagaaaauaaggaauuuuaaaaaagaauuccauagaugugugauucaucuaaagaaaaauuacuaaucaaaagagacuagaauuuaucaucaaaauauuugcaagcaaaggaaagaugcaaagcuaguaaguuaaaucugaaauaugucaauagaauaugagaguugaauuaagaaauuauuuagaaauaacuuauuuccugaguuauuuuuugcaaucgaguuaucuuacuugaaaacaauggccaccaaaaauuuacaacuaauggagucugaguaggcuuugcauaaagaaguaggaaggaauuaaaauuuuguuacaauauucgugauggucuuguuuuucauguaagcgcugacagacuuaguuaagauuguucaagaaagugguuggaauggcuuuccugguauugauagucucuucuagucugcuuucacuagaguuccaaaccaugggguucccugaggcccuuucaagaagucuguaaagucaaauaauuuucauaauacuaauguauuauuugccauuuucaguuucuugacauuugcacuaugguacaaagcaaaaacuucugaugccuuaguauaaauuaauguaguaauugcauuaauguaccaaaugauucauuaucaaguaauuuaugcaucaaacuauacuaguaauuguuguauucuuugcugccacauagcugcagaaaaaaauaaagccaguuccaguuaagaaugucuuugauagaacaguaaaaauuauuaauuuuauuaaguugcaguccuugaguauauguccuuuuaguauuuuguggguugaaauggaaagaacacauaauacuauauucugacgugcaaugucuugagaaaaaauaguuaugcgauuauugagucgauaucugaacuagccacuucuuuuaugacacauuaguuuuacuuugaaaaauagcugacaaacuaugguuauuuagauuucaguauauggcagacauuuucuugaaaaagaacaaagugagccugucacuucaaggaaaaaaacuggcaguaucuggugcuuucaggcgauauuuaaauuuucaagcaaaaauuagaauuuuggaggcuuuguaucuacaacugugacuuugaggguuucccaaauacuuaaugacuuuucugaugagauugaugguugucagaagucucugagaccaaccucagguucagugauuuucuagaaggacuaacagaacauggcaaaacuguuauacucacaguaauaauaguuuauuauagcaaaaggcuacaguuuaaaaucagcaauugaaaaaggugcauagggcagaguccagcagagauuagaugcaagcuuccaguugcccucucccaggggagucauagagacagugcuuaacugccgcucacagcagcaguaugugacaacacgugucaaguauugccaaccaggagaacucaccugagucuugguguccagggaucuuuuggguaucuuucaugaaggucuaaagugcccacgucgcugacuuuaguaacuccaucuguuugacuccagaggucagacugauacugcauggaccaaggccccucccguaaauuacauuguuagcauaaucuguaugguguggcugaaggcuuucaguaaacaaaggcacucuuauuaagcaggauauuucaagggccuugggugggcaagggccaaaccuuccuuuggaauauccaagguguggacaaccuagcccuacuggguuauuaauccuuuacugcauacuggugauauauaaggaauguaauguuuugauaauguaaaugaaauguguuaauaucuggaagaucugcauagcucagugaagcaguauuuuucagaugaucacugcaugaugcaaccuaugauaugcaucaguaaaugauagaccaguggauuuuaauggaauagaauacaaauguuauuauacauguggucagauucuacauuucauuuaacuuauauguaacuuuaguaaguaauagucuucauauacuaugaaucaaagcaauauagagcaacauauugaaugcagaaacagauaaggaaaucugucuucuguuaaguuagauaguaaacauuuguacaaaaauguaaauuggugcugcucuucucauaaauuuuuuuuggagaauauauuuuacgugaagaauauguuaucuguauuaacaguuacuccauuauguguaauuuuuaaauuaauuucuaaacauuuaagauuuucugaguucuaauuucuaauacaguaaauauugacagcuauaaccuacagaaacagaaguucuuuaggggccagcaauuuuuuaaacaucugaacgggccuagagaccuuuucgcugggucuccucuuucugggcuagagguuaucgaaggaugagaugaacaacuaaacuaagggaaagauaguuugcaacuggaaucucagggauaucuggaacuggggaugugaaugcuaccaugaaucuucauuuccaucucuucaucuguuugguccucucagcuucauucuuucuucuuauacacaggcuccucagaguacuggaaaaucuagcaaacaaauaaacaagaacucuuucuuugaucuugcauccuaaaucuuucgcuaucagagaaaaaaacagauuuguuaguaugagugugaaaaaaauacuugaauacuugguucagguguuuaucagggaaugaucaacuaugaguaggccagauuauugaaggaaaaugauacuuucccuguuggaauugagggagaaagaguucccacagagagacugugaguguuuucccugaauuggaugggggcugaacaggcgucuuacaaaucaucuuugagugucaacaaguuguauggacugcagauauuaugggaguucagaguaggggagguuaggguguuuaagugaggaaacucacauuucuaucucaguuuuugaugugaucaaauggcauuuuauacugggugaguuuagguuuaaaauaucacuuugggcacagguggucuuuagcuaaucuaauaucuuugagguggcugaauuuuggcucucccuggagguauagguauuccuugaagggaagagugauagauaacuaccacaggguaggaggacaaugcaaauaguuuggaagccgggcuuuaccaagaaaaagaggaaggagaggugagaaauagcuugaaugggagagugaaagucauucuccaguuuggcuagauacguggauuucaguaagcgauuaugacuuuugaauuuccacauaggcaggacuuuuugacagauuuguuuuccucaucucccaccugccagugucuacuguguucaaggcauugugccaugugcuagacuagagaauugugaagaugacuuaaaugucccccaguauccacaaguaacuuuuuacuuuaauggagaaaacagauaugaaaaugauugauuauauuacagauaagauaaaaugccaaaaaaagucuaagaaaucagcugacaucaugguagacgauuaauuaugaccaagggaucaacgagaugacauuuaagguagacacugaagaaugagagagauuucuguagacaaagggauggcaauaaggacauugcaaauuaaaggaguagugugaucaaagaggucugaaaaugcauguuugggccgggcgugguggcucaugccugcaaucccagcacuuugggaggcugaggugggcggaucaccugaggucaggaguuugagacuacccugaccaacauggagaaacccugucucuacuaaaaauacaaaaaaugagccaggcgugguggcacaugccuguaaucccagcuauucgggaggcugaggcaggcaggagaaucgcuugaacccgggacguggagguugcggugagucaagaucaugccauugcacuccagccugggcaacaagagcaaaacucugucucaaaaagauaaaaaauaaaaaauaaaaaaauaaagaaagugcauguuugguuuguuuaagaaaugacagguaguccaguggagacuggccaagccauaaagauuacugaaugcuguaccaguuguuuagauuuaauucuguaagcaaugggacuuuuucaguuuugauuuguguuuugggcauaguuguuucuggagauaauauuauagauguauaaagagauggaagaccaguaaaacugaaaaaucuguuguaggaauagagaacauaaugggugggaaaggaaaugacaggauggaagaagagagcauaggaagguggaauuguuaaggcuuuuugacugauuggauaugagggaaacagguagagaaauaggucagagauacugaugagaaguuuccaucagguugaauuguauuuaauuuuuuggucuuaaaaaaaccagcaauagaugguucagcucauagcuuggguaucuggauugauguuaauggcaaguaaagaugagaaacaggagagagaggagagguaaagagaaaggcugugggacgaaugaugauggucauuuaaaaaaaaaaaguguugaguuuuaguuguuaguugagauauccagauugaaagauccaguugcugguggaaaugcaauucugucuuuaagguugaugggagaguuaggaauuauuuacauuguuaaauguucuuuauugugauacuggaugaguaugacagauaugugaccuagauuauuagauaagugacacccccaucuuuaaguuuguuucagagauccuaaauaaaacauuuuugaauauuacaccuuuuugagggcauuauauuugggagcuaggcagaaugugguuuccaaauuauguaaaguauaaagaguuuuauauuaaaauggauauauuauucugauugucauauucacuauguucauaaagaaguacagaauuacaacacagcuucuauuaauggcuaacaggcaaaaacuucagucuuaguccauuuucuauuacugcagcagaauaucugaaacugguaauuuauuuuaaaaaacuauuucuuacaauuuuggaugcugggaaguccaagacugggcagggggguuggcaucuagcaagggccuucuagcuacauaauaacaaagugcagguagucacaugguaagagggcaggagaaugccagcucaggucucuccuucucuuauaaaaaccaccaaucccaucaugggggccugccccacccugaugacccuaucuaauccucacaaagguaggccucacaaaggcccuaccaccaaauacugucaauguaugaauuuggggauuaaguuucuaacaaaggaaauuugggggcacauucaaaucauagcagcuuccuuuuaaaaaaaucuuguguuuuuaaagaagugugcuaucuuuuggguuuuucagagacccucucaaccuagaguaaauauagaauacuauuuaauaaucucauauuagaauguuuaauaugggagaggguugaacaacugcugucaagauuauuuuaugugcuauuaaauaaguagcaccuugcgaauaauagucugcuuccauuauuuuuguauauuaguaaucaagcagauuaaauacuuccuaggaauuaugguuauuuguuuuacuucaaaaacaauguugauuuaaaguacacugcagguuuaaaaaguuuaauuucaaaaaauggauauauaggcugauucuuuuuucuaauuauugaaagucauuuggaauugcaauaaaaauuuuucugugguuucuucaguaauuuguaauucaauuuauuaguaauuuccuuaaaauuaaaaaaauuauggacacuauguuaaaaucuguauaccaaauaauacauuuuaaacucacauuuuuggauaauuuucagaacuauuaauguuuaacuuuuuugugcuagaaugcucugagaccagaucuguuuguuugaaaaagcaaauuacaaguauaaauuuaaagcaaauaugacgaaugguuagcuugugccuuggcuucuguugccuguaauagaugugcccucuaagauguucuugcuaugguaccuggaagauaauuccuucuuugccugguuacuauaguuaucuuauugagggccaguugguuucagaaugcauuuuaaaaaaugggaaaaauagcugcggaaaaaauaauuagcuuuucaaaagacaguaauggauagcuuauuccgauucccagguuaucaguagauaaacaguuaaauggacaaucacaaaaauacuucacaaccaaagguucuucuucauuuuucucauccuuaaauuuucuaccucucucccucaaauuucauggcauuuuauuucaugugucaggauugccacuaucuaaauaucuuucuucucugaaauuucuagaccugucccacagagacuugaggauugagaacauggagagugggaguaaggaaguugcaugguccuuccuguaucuguuuuuaauacccugugccucagcaucccuguuuugggggaacuuccugcacauaaacugucaaagccucucacaauuauagauacaaagcuguuuucugguaacuuguggacucacugauuucuucuugcaugugagaaaaagagcuuuggaaauuaaagcggcucuaaagugccaagaaucugaguuuaugggaaaagucaccugacucugcuacuuggauaccacauuuuuuuuuuuuuuggagaaagagucuugcucuguugcccaggccagagugcaguggcgaaaucucggcuuacugcaaccucuaccuccuggauucaagcaguucucaugccucagacucccgaguagcugggauuacaggcgugugccacuacacccagcuaauuuuuguauuuuuaguagaguugggguuuuaccuuguuggccaggcuguucuuaaguucccggccucaugugaucugcccgccuuaaccucccaaagugcugggauuacaggugugagccacugcgccuggcggauaccacaaauuugugguaacuucaucuguacuuuuauuacauggugcucuuauugcaguccuuuuguuugugcguuccagacuuuuaauaaauuccccuuagcugcucugcuuugccauuuuaccacacugcuuaaggccuaucuucuuccucauuagauggccucgauuacuacuuuauagggagaaucaaaauuacauauuuucaaguucacucaucacuuugcuuauuugugaccuuaaggaauuagacuagauaucugaaagcuuuuuccauccuagauauuucaucuuaaaauaauuuucucuacuuuuuacugugaggcaacuguguauuuguucuuuugccauucuaugauuguagacauuguguuuccaccuaucuuuugucucuucuguuuuuaaggaaaagaugaccuuuuucccuaauaagacuguuuuucucaugcucuuuuuuuuuuuuuucuuuugagacagaaucuugcucuguugcccaggcugaagugcaguggcacgaucucagcucacugcagccucggccaccuggguucaauuaauucucaugccucagccuccugaguagcugugauuacaggcgcauaccaccacacucagcuaauuuuuguacauuuuguagagacaggguuuugccauguugcccaggcuggucuugaacucaugagcucaagcaauccgcccaccucagcaucccaaauuucuauaauuacaggcuugagccaccgcgcccagccguuuuucucacacucuuaagcucauuuuuucccauuuuuuuuagagcuuugccuuuucaaauauccccccuuuauaauagauaguuguaaugaaacaguuuucuaaaggauauuuagaguaaugguacuaccauuagguugagauucauugcugggcuaaaauguucuuggcauuuugaagcgugcuuucauauaucauauagaaauccagagaacaguucuaccugagcuucuauuauaacccccacaaauauuuguggauucccuacuguaugcaaagcacuguacuaagaaugcuauaggguauauaaaaaucagcaaaauuuggccuguuagaggaggaguuuauggccaguauaggggaacauguaaaaaaguacaaugagauagaggaagauugauaucuaaaugcagaggauuuuaaaggaggguguauuaguuugucuucacacugcuauaaauaacuaccugagacuggguaguuuauaaagaagcaauguuuaauugacucaguucugcaggcuguacaggaagcauggcgggggaggccucaggaaucuuacagucaugguagaaggcaaaggggaagcaagcacaucuucacauagugacaggagaaacagcaugugaaggggaaugugccacacacuuuuaaaccaucagaucuugugagaacucacuaucacgagagcagcaaggggaaauuugcucccaugauccaaucaccuccuaccagguccccucccaacacugggaauuacaauucaacaugagauuuggauggggguacagagccaaaccauaucauucuccccagccucucccaaaucucauauuauucucacaugucaagacacaaucaugccuucccaacagucccccaaagucuuaacuccuuccagcauuaacugaaaaguccaaagucuuaucugagacaaggcaaguccauuccaccuaugagccuguaaaauaaaaaacaaguuaguuucuuccaagguacaaugagaguacagggaauggguaaauguuccuguugcaaaugggagaaauagccaaaacaaaugggcuacaggccccaugcaagucugaaacccaacagggaagucaugaaaucuucaagcucccauauccuuugauuccaugucucacauccagggcacgcugaugcaagggguggccuccuaaggccuuuggcagcucugccccauggcucugcaggauacagcccccacagcugcuuuaaugggcuggcauugagugccugcaacuuuugcaggcacacagugcaagcugucaguggaucuacccuuguggggucuggaggaugauggcccucuucccacagcuccauuaggcagugcccuaguggagacucucugugaggguuccagucccacauuucccccucugcacugcccuaguagagggucuccaugaggacucuggcccuguagcggaguccugccuggacauccaggcauuuccauacauccucugaaaucaagguggaggcucccaaaccucuucucuugccuuuugugcacccacagacccaacaccauguggaauccaccaaggcuuguggcuugcacccucugaagccauggcccgaguuguacauuggccccuuuuagccacagccacagcuggagcuggaguggcugggaugcggggcaccaagucccaaggaugcaguuagcagcagggcucugggacuggcccaugaaaccauuuuucccucuuagaccuccaggccuguacuggaggggcagccaugaagaucucugacaugcccugggagacauuuuccccauugucuuggcuauuagcauuuggcuucuuguuauuuauguaaauuucuaccacuggcuugaauuucuccccccaaaauggguuugucuuuucuauagcauggugaggcugcaaaauuuccaaacuuuuauguucugcuucccuuuuaaacauaaguuccaauuucacaccgucucuucauacauaugagcauauacuuuuagaaaaauaccaggucacaucuugaaugcuuugcugcuuagaaauuucuucugccagguacccuaaaucaucucucaaguucaaaguuccauacaucucuagggcaggggcacaaugcugccagucucugcuaaaucauagcaagagugaccguuacucugguucccaauaaguuccucaucuccaucugagaccacaucagccuggauuuucacuguccauaucacugucagcauuuugguuacaauuauugagcaagucucuaggaagucugaaacuuucccacaucuucugucuucuucugaucucuccaaacuguuccagccucugccuauuacccaguuccaaaguugcuucugcauuuugagguaucuuuauagcagugccacacuucucugguaccaguuuucuguauuaccuuguucucauacugcuacaaagaacuaccugagacuggguaauuuaugaagaaaagguuuaauugacucacaguucuguaggcuguacaggagucauggcuggagaggccucagaagacuuacaaucauggcagaaggcaaaggggaagcaagaacaucuucacauggugacaggagacagagagaguaaaguggggaagcgccacacacuuuuaaaccaucagaucuugcgggaauuuacuaucacgagaacagcaaggggaaauuugccuucaugauucaaucaccuaccaccaggucccucccccaacacugggaguaacaguucaacaugagauuuggguagggauacagagcaaccauaucagagggagguaauguauucaguuaaaggggauuaaaaauggcuuuaugcaaguauacuuuucccuguaacucaacauaguguuuugacaagcaaaaauugaaugaugacugcauugugaaaagacaaggugaaaacaagguaguauuuguagaguuacacauagucugauuuggcuagaagggaggcuggagccuuucaugguggcuuuugaaugccauggugaauaguuugugcuuuauuuguuauugaauagcaauuuguacacuucugagcuauuagagugaaaugauuaagccugugguuuaggaagaaagagccuauuagggagauaaaucuuucccuaguuguaggaaggguuggaacaguaugauauggagaggguaguaaugaaugaaggaauggaaaacgagaauaauuucaaugauacuggaggugcaguauacaaguuggcaguaguuuuaugucuaggaagauaagaaguguuuaggaaaaacucccaaauuguuuuuccucugcucuuacaccacaacaaucaacacagaggacuucuguguccaaaugcacaguauuucucccugccaaauaagcaaucaguucuacagugaacaccagcuaauuggcuuucaauucauuucugucacuaccuagagauagugucagauucccaacggcugagggcucagucuuggggucugggcccuccuucccacugguuguaagucugcaucucuggaacuucuaccagauggcuucgaguugggguuuccacaacccccucuuuggguuggauuaauuugcuagaguuacucacagaacucagagaaacacguuuacugguuuauuaugaaggauauguuaaaggauacaaguaaacagccauauggcaaggucuggaugccauagggcaaggucuggaagggucccaaauguaggagccucuguuuccguggaguuaggguaugccacucucccagcaaguggaugaguucuugcucaccuucuugcccaccuucacauguucagcugugaggccaguccuuuugguuuuuuauggaauuuucaugacaucagcacuuuccccaaugggaagaccccccauaggacccucucugaaaugagggcauuaugacccacagucagaaaaguggaggaaaauuagaguccugccuuggugcagaugaaaggagggcaggagaaggucagggauauuguuuccugaggccuaacacaccaaacauuguaauaaaagacuauaacaagggugauauagcuugaauguguguccccuccaaaucucguauuuaaugagaccuccauuguuggaaguggggucugguggguguuuggaucauaaagguggaucccucaugaaugguuugcugcccuccccugugguaaugaguucaagugagagcugguuguuuaaagcagggguccucaaccccuacuccauggaccgguaccugucuauggccuguuaggagcugggccacacagcaggaggugugagccacaggcaagcgagcauuacugucugagcuccaccuucugaucagcagagcuuagaucagcagcagcauuagauuuucacaggagcgcaaacccuauugugaacuccucacgugagggauauagguugugugcuccuuaugagaaucuaaugguugaugaucugagcugaaacaguuucauccugaaaucaucuucccugaccccuugucuguggaaaaauugucuuccacuaaaucagucagucccuggugccggagguuggggacuacugguuuaaaggagccuggcuccuccccccuucucuugcucucucuggucaugugaugugcuagcucucccuuugccuucugccaugaguaaaagcuuccugaggccucacugaaagcagauuccagcaccaugcuuccucuauaguccugcagaaccaugagccgcaauaaaccacuuuucuuuaccaauuacccagucucaagacagacuaacacaaagggcuaugggaguuauaagccaggaacuguggacgaaaaccuauuuuuaaaaauauagauauauaaacacaaccacauacauaaauaaaauaacaccacaagaaggaaucaaaguugcuuuugaaauuccaggucuggacacuaggaaggaugcugguguuauuaauaaagaggaagagaagugugagagugucuguguguuuguggagauauuugcuaauuuuuuaagauguugauauauucaccuuaaggugaagauucuugggagagcuuuguuaauuuaagccuggcguuuaggaaggaaguuagauuuagagagggaaauuuggggauugcucucauagagguuauaauuugagcugauggauaacugauauuuccaugacugugaauaaauacagaaauggaaaauucugaggaaaaggcacguagaaaaugccuuaguuuuaggaugacuuuugaguaaauuguguaauauuucacccuuauuuuuuuaaaaaaguuaaauaggagaaacacuuugagaaagcauagagggagaaaacuaaugccuuaaaacauugccuaacgcauaauaggagcuuaaaaaaaucuuuguugaaugaauaauuguaacuuguuugggauauaagccuauguauaguagaaaaaugggcauauuguggagaacuuuugagggagagaguggauaaugccuguuccccugcccugugcucauaggguuauugcugauaccagaugaaaggacagaucugagaauauuuugaacuuuuaaaauguucuuugaggcauauuucaguuugaggaacugaaagaaauuccauaaguaagguaguaugucuguauucagcaaguaagguaacaugucugcauauaagcuuauauucuuuccauuuuauuuggugggaauuagauuuguaaaguauauuguaaagaauguuuaggguauuguuauggcuauauaucuuuugauaagucaauucuuuuuuuuuuugccugugcuuuuucccacugccuguuauauuuuucucacuuuccuucucagucccucacuuuuuccaagucaguugccauucaucuuuuaggucucaguuuagccaucaguucuuucaggaaauguaugcuaaaauucuaagacugagacagguauuuuuuuguaucccuguguauccuccuacuuacuauaccagauuacaguugcuuaauuugucugucuucuccacuagaaccuaaacuuuccugucaugguguucugucguauuuacuguuauauucuaccauguagcacaaugcuuggcacauaguuuguuggagaugaacuaaauaagagacaauguuagacuaaaguuuacuuuuaaccuucagacguagugauuucuuaucuucaugugcugaaugguaugauacuauaauuguugaaguucuaagaaaaacccaacuauaagaauugauacuguuuugaggauuuaaagaacacagauacaagagauugaaaaugugcuguagguacuaauacuagccuccugcuaguagguauugugcuagccuucccucccuuuuccuccucucuuucaacauuugaucagugcauaacauuucuuggagaggugugguuuuuuuucuucccuucguuaucuguuuacuagggugaugggaguuaaagguaguaaaaacuucacaaucaugguugagugcauuucaguguaaacuuuguauucucaaccuuuuguauguuagucuuuuagugaauuuuggguggacagaguguaugauagugcuguuucuuuagaaaugcucucucgaaacuaaaaccucuuggauucuguaaauauguuaccuguugaaaaaggaaacagcauuucugcccuuacuuugaacuaacuugaucugagauaaauacauacacacaugcacgcaugugcacacacacauacauaugcacucuaguuaucugguuauauacaaauauacccaagaauaccuaauauaaacacgcccucuucuccccuuccucaaguuuaagugauguguaguuggucuaagggguacuacagcuguuuugcuuagccuagugguuguucaagugaauuuaccagugacccaauuuuagucucuaucauagugauuugaaaaaaaaggccaaguaaagucacuuaguaugagauaaauuuucuuuacuuuccucuucacuuuaagaaaucaguugcuuuuuuaauuuuuuuauuuuuuuuuaaccuuuagcagacuguauuaguucauucucaugaugcuaacaaagacaaacccgagauggggucacuuauaaaggaaagaggcuuaauugacucauaguuccgcagggcuggggaggccucaggaaacuuacaaucauggcggaaggggaagcaaacauguccuucuucacauggugucaucaaggagaaguacugagcaaaagggggaaaagccccuuauaaaaccauuagaucucgugagaacucacuaucacaauaacagcagcauggggguaacugcccccauaauucaguuacuucccaccgggucgggucccacccacaacauguggggauuauggaaacuacaauucaagaugagauuuggguggagacacagccaaaccauaucacagacaguaagaauauauuuguuacaaauaaauaugggagcuuaagaagauuuuuauguuuuagcaaaugcauaccaacuugaaaucaccaauuuaguuuuagaagacacaagcguguguaacaaagucugauuagcauuuugaggcuuguagaauaacuucagaaguuuguaguaugaucaggcacacagagucccaagugauucagaugcaaaagauuucuuggcaauuggauuucugcauguauguuucucuguagcuacuuuggugccugucaguaauauaaccaaaaggaaaaaccaaguggaaaguaaaaguaaucugcugguaacuucaauuuaguuuucuuuuuauaaaaggaacucuauugauguuagcacuguuuuaaugguuuucuguuguguaguagacaguuuucauuugggauugucaaguuaguuguaaauaauuguauaguuucaaugaaaugccugucuguauucacacuaggauauuuucucauugcacaaauuuccauauuuuucucugaucaagugagacagauuauaaaacacaaaggccccucuaaggcccuucggauguguuccagcaauaugcagcagccccccacccccuuuuuuauuuccccugugacagggucucucucuguugcccagucuagagugcaguggcacaaucuugucucacuucaggcuugacuucccgggcuuaagcuauccucccaucucagccucucgaguagcugggaucauagguaugugccaccaugccuggcuaauuuuuguauuuuuuguagagauggcguuuugccauauugccuggguuggucaugaacuccuggguuccagcaguccccuccucagccucccaaauugcugguuuauaaaguugggagcuacugcgccuggccacagcacacauuuauaaaaaauguucaugugauuccaaauuuaaaauagagugauuucugugacuuuuuuuaauuguucacuuuuuuaacaugcaguuucaucuuagauguaugauauuguauguaaauugauuuguauuucuaaaaaaaugaaauuaagggacuccauaucuaccuguaagauuucucaacaaaaauuuacaaagcuagcugggaagacauguauguacuucuugaauuuccuccugcuauuccuuuuccccaucuuccuuagagaggcaaagaagaagagagagggagauuuacuuuuaaaauaggagaacauuaaaugcuuuauuauuaauguguuacauuaagcaguuuuaagucauaguaucucaaguacauacuauccuuuauauugcccccaacacccaaaauauacacacauugggaaaagaaugggggcucuuuggggguuuccuucuagaguugccaggugaaauagaauuucuaguuuauuaauaguauggcacuugcagccccaauuaauuugaaugcucuauaauguucaaaaagaguuuugagaaaauuuccuccuaaaauuaaugccuuaguagaaaaaaagauugguuucuccuguucucuuccccaaauuagauggaaaguaaacaagacuggaaaauagguaauugagacuaagaugauucacagauugaucacccauuuugcaacagucauaaaauuuguuaguuuuuuugaagaaguuuauuaaucagucccauauccuuugaguauccucuacuccccugugauacugguuugauauuaauuaagcuaauauuuacuggguucuugguauccauuagguauucuucuaagcaacuuuauauguguuagcucauuuaauaauaauauuaagccaacauucucugagguagacacuauuauauuccuuuuauagaugaggaaacugaggcucagagauaaaguaaucugccuacauuugcgcagcuagguggcagagcugggauucaaagacagugacucuagagucuuuuaaccguucuacuauaaagccuauguaguauuuuucauuuuuguauuuuucuuuaaaggaauuuaguacaagucauuaauuuuauucugagguugagauagaaauuaauuucccuaauuuacaagugaugguaacgacauaaaaaauguaaagacuuggccguaacuguggagacaguuucugacgagauuugguauguuuaggguggcauugccauagauuggagguuucuuggguuucuguuaagucuuggucuucugcuaguaugcauugucucuuuugaacaagcucagggagugucagcauaaucauacuucuuugaguucugucagccuaaacuguuuucacauucuuuucacaugucagaauuuuuggcugggugcaguggcucacaccuguaaucucagcacuuugggaggccgaggcaggcagauuaccugaggucaguagcucgggaccagccuggccaacauggugaaaccccgucucuacuaaaaauacaaaaguuagccggaugugguggcacacaccuguaaucccagcuacuugggaggcagagacaggagaaucacuugaacccaggaggcggagguugcagugagccauaagagcauggcacugcaccccaaccuggguaacagagcaagacuccguuucccaaaaaaaaaaaaaagagagagaacuuccuauguggacguuaaaaaagaaaaguuuuuguuuuguuuuuuacauuggcauggugguuuaacuagaugacuuauaaaguauuuuucaacauuguuuuaugagucaacacuucuucuuucauuggacaaauacuuuuaaaacuuauuauugcuaugugccagguauauucuguguuauaauugccacaaaugugagcagauugauaaacuuuaacuuagaugaugagcuauuguuuaguaaucucauguuacacucagaguauucucauaccaccaguaugauucuuaugcuuauguuucuuugagguauucuagauuccaguugaauuuuuuuuuaaacuuauuugaaaacggucaccagcaaaucuacuuuuaaagagauauaauaaggcuuugacugugaagacuuaagaguaauagugggguugauuaaauauguuuucuuguauuucuuuguaauuuuauugcugugacuauuuguagaggcagaaaguguagcauuuuuaaaaauugaguauuuuagacaaauaaccacucccaaaguguucacucuugggaaauguuauaucuuuguuauugagaguauguuuuguaaagccauaucccaccugaaauaaaaagaauuacagacuucagaaaguuaagguagacagcauuuucuuggcuacuggggcuaauuagaauauaugauucucuaugcaggacagccaccuuagggacucugaaucucucaguaggguaaaauuuuuauauuuauauaaaagauuguggguuaaaaaaugguugagaaauacuguuuuugaguaaacccaaggacugguguuuaaagguuauauaguauuuuacuuagguucuagaaaucuguaaggugucugaaucaaaucuuguaacauuggauuuauugugauuuauuuauaaaacauuuaaggaucaaaucaacuaaguaaauauuuacaagcugauggcuggauaauuuaauugcaguuuauagucauaaucaagaauugacauguuuugcuuuauguguuugaagcuuacgaccuuuugacaugaaggaaauugcuaacauuuaggaaauaguuacuuauuuagauuaaugucuuucuccugaacugacuuauccauuuuaaugcucagaucuuagaaaguacauagauguaaaaaaucgacucggugugguggcucacaccuguaauccuagcacuugggaaggcugaggugagcagaucacuugaguccaggaauuugagaccagccugggugacauggcaaaacucugucucuccaaaaaaaaaaaaaagcuggaugugguagcaugugucugcagucucggcuacuugggaggcuguggugggaagauggguugagccugggagguggggguugcagugagcugagaucguaccaguguacuccagccugggcgacagagugagacucccgucuuaaaacaaaacaaaacaaaaacaacuaaaaaccacaaauaaacauauauauuacuuaaaaucauaaguuggauauuucuuauaaaguaguaauuguguaaugccucauguaucucuguguaucauuucaaugguaaguucaaaagaugaaggagauuaaagaaaaaccuuuuucaucuugacacuaccuaagacauaacagaaauuuaacaaauaacaaguauauaaaaauagagauuuuuaaaaauuguccuuaauuuuaucuuuguuggguauauaaaucugcucucugggauaguucuacugcuuuaaguaaugaggaaugcacuaguuucauauucuaaggauaaccuaaggauaucccauauauuuucacaacuaaauaaacucauagccugaaauuucaaaauuuuauucucuuaugucguuaaauuauaguuccuuaggguucauuuacgaucucugguguaaacuuuccauuucagauuuaaaaagucccugagcucuugaaaguuaaauuuacuugucauuugucucaaagauaauggcugaacuaagauuaggauuuuagaggaaugcaguauugauuguucuuucccuucuuccucuaguacuaacagguuacaauuauauuuuguuuguuaagucguaauggaacgcuauaaauaaguucauuauuuucagccuuaugcauagggcucuaaauaaauagcuugguuuuagaagaaaacuaaaaguaauucuuuccauaaguuuuaaguuucuguguuuuuguuuuauuuuuaaaaauuaaggagucaaaaauaaugggcuuuuauuacaacaagcuuacaaaaauagucauaguaacauaaugcuuuuaucauuggcuuauauauuauauaaaauacauacauuauuacacauauaagauuacaaauaaacuuugguaaagcugaaguacuauauuauguuacauaauugaauauaucaauguaauaugaauguuuauuguuuuucucuggauguuucaaauuaggcuguaaguaucuaaggaugaguuuggcuaaacuaucaaauguaaaaauauuuuauagcaauuacuuuggagauuuguuaccaugccuguaugauacuucuaguauauuucuaagcauguuucuguuuauaucaguccaugaggcuuuuauaggcauacuugguaugcuagaguuacagccaguuucuuaaguagaucauuugauaguauguagguagaacacaguuaaacugagagcaagaagggugaagggacaaaggugcuauuuauucucccacauguuuguuacauaaauuuggaaaguugagugcaaauguaaaauguauagucauggaguagauuaucuuagagccaaagggauuaaucagcuucacguucaaacaggaaauuaaaauagcauccuuuagacaguguaauucuguuuuccugucgcagggcacaaacacuaaaauggaauaaaacauuuuauauucucauagguuccaugugccuugugaagucaugguuccucaguauaagaucgagguaguaaauuaaucauuuccauuugucuaucuuuuauuuuucuaaguaaagaucugguugcaguaguguuuauauuuugaauagcaggcaauccuggaaguagggagauggguagaaauggaagagauuuauauaugagaugacuaggacugagcuuuuagaacaaauuaaagaccaaguaaaugaguauuuuuugagacugagguuaaauugaguuaaaauuggaauaacugguucagaguaaaauguaaauguuuaaguuacauguaggcauuuaaaaccucuaguaguauguuuuucaaguguccauagaaauucugcacuugcuauuuauauuguaauaucuucucuguuuuuccccuaggugguaucacggaaaacuugacagaacgauagcagaagaacgccucaggcaggcagggaagucuggcaguuaucuuauaagagagagugaucggaggccaggguccuuuguacuuucauuucuuagccagaugaauguugucaaccauuuuagguaagucuuuauuccuauuaugaagccaaaugauguagcuauuuugauauaauauucauaaauauaccuguauaauaaaggugaaugacucaguaacaaauaauagagaaggaagcuuguuuucagucaaaugauuuaaucagugauuuagagagauucuuuugaauguuuacauuuuuuguuuaaaaacaauauuguugggcauuacugugcugauccucaaauauauuuauaguuuuuaaaguauaaagaauuacaaauaaacuuugagugguaaggcuaaaauaaaggaauuguauacuuuuagacugcagaauaacaaaaaguguaggaaacccuguuuaaaacucaaauuuuguguccuuuauuuuagcuucacuauucuaaaacucuucgcagacaugcacuucagugaaacagacauauaaauuuucaaguacaaauauucuguauauauaaacauauuuacccauauuguauuguuucauuuuuauagaagaaauugaaaaaaaucaucuaaugcauauaguguuaaaugauaaaauguuuguguacccuugguuuuuagauuuuaaaauaagguucaguaguaccaugauaccacauguaguaugugaaauuauuacuguacuuuguguaaauauugcaagagaucugugagcuccuuuuagccauauaaaacuuauuaaauuguuaauucagccuuaaauauggaaagugagaagagguaucugagggugaguuuucagauauuugauggaauucuguaauugagguuuauaagccugauauguauuucacaucaaaugcauguauauauauguaagagaaauagccccaaguaauuuacugugaugaagauacuaauaagugguauuuuaguauaaggauauaguuacaaggaaaagaguauggaaauuauggauuuauaauuucuuuauaaaacuugauuuuuaaaauuggcuguaaagauuuuuuuauacuguauuuuuuccuguucaaauaggauuauugcuauguguggagauuacuacauugguggaagacguuuuucuucacugucagaccuaauagguuauuacagucauguuucuuguuugcuuaaaggagaaaaauuacuuuacccaguugcaccaccagaggcaaguaaaaugaauaaaauaucuuucaaaacuuuauuuuuucaguacaauaaugguuuuagcuauugcucaguuucuuauguuuauuauaauucaagaaguauuuguuguauuaaauuuuaauucggguuauaaugucagaacaaaauggacaacuucuuugaaaaaaaaagaaaauauuuuucaauaauuuuguauuuaaguaaccagauuaaaagaaaauacuguauggugauagccuaacaaauauuucugaauguaugggaacaaauuacugauuucauaguauuaacccugacuuugcugcaagauucugaaaugccuuguguaucaucaaugaaagguuaauguauauguuucauguaguauauuuaaaaugaaaugaucauucauauuacguuauaaaagcauacugcuuauauuuaaaauaugauuuucauaaaaacaggaacaacaaaaaagccuuucuaggcacuggguauuuauaguccaaguaaaaauuuauuugaaugaucccauggaguuucuaaugugaauuuuuauuggcuuuauguggauauaccucuuuugacuuuaagauaaaaagacuaucuuuuuaaaucuuuuuuuuuuuaugguuucuagccaguagaagauagaaggcguguacgagcuauucuaccuuacacaaaaguaccagacacugaugaaauaagguauuuuauaaucuauucucauguauaggcauuugaaagagcuagacuucgaagauuuauuacucuuggacuaggaagcuuuugaaauuugaagaaauggcauacagcaaggugaaagagcuuuugauauugggucuguugguccuguaucucuggguuggcuuauuuguucagacugugguuuuggaucaggguggccucagugaauaugauaggagaaauaguuagguuuuauuccacugucucucacaaaguaaggagaguucugcuucaaucuauaugcuauguaaauuuuuguuaccaugugacauuuaugccacagcuauaaaggauaagcuucuacuuuauguaaugggugaauaauuuuaaaccuuaggaauguuauagaacuaugcaacauguuaguuugugguuuuauuucuauauaauuauauaauuugauaaucagauuaucugugucuuucuauaagcuauuuaauuuucuaguggaaacuuuguuucuuaccauuaauucucucauuuaauucuuacugacacauuuuuauuuguaauguaaacuggacaggccuauaaaugacaaaggaaaaaaugcauauauugaagaacagggaugaauuacaaauuuaugaauuuagguaauuuuaaaaaauuuuuagugggaucauuuaggacagcaguucuguaaguguguuucauguaacuauggggaucuuugagauccauuuagaagguucauguauuagucaguguucucuagaggagauuuuuuuacggagaauagguuuacacaaugauagauggagacaguaaagacccacaaucggcugucugcaaucugaaaacccaagaaagccagugguauaauucagucuacaucugaagaccugagaaccaggggagccuaugguguaaaucauagucugagggcaggagaagaugagaugagaugucccagcucaaccaguaaggcagcagaaagggaugaauuucuuccuccuccauuuuuuguucuguucagacccucagugaauuggaugaugcccacucacauuggggauggcaggauacuguccucugauucaaaugcuaaucuuauccagaaacacccucacagagaaacccagaaauauaauguuuaaucugggaacccuauggcccagccaaguugacacauaaaauuagccaucacaguccaugagaucagauuauuuucauaacauacuaagacauaacuugccuuuuucacuguaaauuuuacaaugaugguacaaaagcaauggaugguaaaacugcuggugccuuaauagaaaucaaggcuguggcacaaaaguguacuguauucuucacuguuacacacuuagaguuaaagacaguuucauugaagaguguuguugaugagggaguaaaaaauauuuauugaauuucaaccugugacuacacaacuuuaaucuguaugaugaaaugggaaguauguauaaaacacuucugcuguguaccagggaucagugucaugaggaaaagcagugaguugagagcugaacuaguuuguuccuuuuuuuuuuuugagacagaaucuugcucuguuacccaggcuggagugcaguggcacgaucuugccucacugcaaucuccaccuccuggguucaagggauucuuugccucggucuucugagcagcuggaauuacaggcgugugucaccaaguccagcuaaguuuuguaauuuaguagagaugggguuuugccauguuggccaggccagucuugaacucuugaccucaagugaucugcccgccuuggccucccaaagugcuggaauuaugggcaugagccacugcaccuggcuuagcuguuacuuuugugcacaccauuuucacuugagagaauguuugacauuuuuugaagaagaacagagugagucuauuauuucaaggaagaaaacuuaguguuuguugccaaugacaaaauuugaguuuugaguaaaaauuugaauuuuagacauucuguauuggccaucaagaguuugacagcuucugaaauaaugacuuuucugaugagauaggugaagauaauaaagaaugagguuuuuuuuuuuuuuuuuuuuuuuuugugacaguuucgcucuugucacccaggcuggagugcaauggugccaucuugggucacugcaaccuccgccaccuggguucaagcgauucuccugccucagccuccugaguagcuggaacuaugggcgucugccaccacaccuggcuaauuuugauauuuuuaguagagaugggguuucaccauguuggccaggguagucuugaacuacugaccucgggugaucugcccgccuuggccucccaaagugcugggauugcaggcaugagccaucguggcuggccaagaaugagagguuuugauaguguauaauguguuaacaacuagaagauauagauagcucagugaacuaauauuuucuaaaaggucaacgcauguuguuacaaaauuaugcauggguaaaagauucauuuaaagugcaagauagaccaauagauguuauuggaaugcauaaaguucacugauaaauaguuuuggauuccauauuacaacuaaccuucaagaaaguaccacucguugaguuuuugguguaauuucauagaauaucuauaauuaucagaaaaggcuauuaaaauacuuauccuuuucacaacuacauucuuaggugaagccagauuuuccucauauguuuuaagcaaaaaaaucauauagcagcaaauuuaaugcagaaacagauaugggacuccagcaguuuucauuuaagccaggcauuaagagauuugcaaaauuauaaaacagugauauucucacuaaauuuguaaaaguaucuuuuucauauuuuuaaugagcuauuuuuaaaggaauuagugaauauuuucaaacauuuguuuuaaauuugaauaugguaaauaucaguagauauccauauaaauaaaagccauuuaggaugucauuuuuaagaguguaaagagguccugggagaccaaaaagaaaaaaaaaauagcugaucuaggaagaugggaauuuaaauaauacuuugaugauauaaauuuggauuuaugagucuuuuaaaaaguuuauacacaccuguggauuuuaaaauaaaaauaccuuaaaaauuaaugauuuaauaaagcacuuuagccuguuuuaggggggauaacacaaaauaauauagaaugaguuaugauuagauuguauuacuacuaacaagcuuauuuaaaacuuuuuuugguuuuugcaccaugaaaaguugguauagcaacaacaaugaaacuugaaauuagaaauaucucuuauggcuacuuuuaacuaagaaaugaaauuuaccaguucaugugcacccuccuuuuacucauaaugauuuucuuuaaugugcuuauuuaggugguucuagaaaggaauaguuuaauugguuaagugguaaugucugcugccauucagcuagugaaauauuggccaucauuaagaaggauuguagaaucaagauagaauacaauauucuaugauuauucaaauauugaguuaaauguuguauaauacaaguucuguugucugaaacauuguccaagauacaaugaagcuugagauagcauagagaaagcaguuaaagcuuucaaggauaggagaagagauuuacuuaaauuuacuuaauagauuuugauuugugaauauuaagauugaaaggaaaauugcuggaaaaaaagacaaauacaguuauagauacaggguuaaugguaccauccaacaaaucuggaaacuuuguauucagaugcauucuuuuaagccugaaaggacaaauucaagaauuacuaaugguuuuauauugaugaaauacaucagcaacuuguuguuuccauaauuguguggagguugaaaacaucuagguuucaguaaaaggaaacuaaguuguauaugcaucucuguacucuuaaauugguaacagaaaaaaaacauacauuccuuucucauaauauaucccuugguaccuaccacuuucagagaaagaaugcuguacccauuggauaauggguaucugggugaauuaaacaagcccugguuuuuuuauaagaaaaauguuaacugacauaagcaucuacaucaugcuuaucuaaaauaaacauuuucugaaguaacucuauaucuuauguauguauaguguguuaauuauauuuauuuuguguuuugauuuuauaucuacccuacaucugaaagaguaauaacauugaagcauaaguuuuucaauucaguuuucuuguaguuacaccccaaaaccuucaauauauguacaaucaguuucuguuaacagaaguuguaauuugaaucuaacaauaauucagugauauaguuagugcagauacuacuaucaaacccauuuuacucaugagguaauuaaaauucagauuauuuauuauuuucaggaauugacauguggauaaugccagaaauaggauacaaauuuaggguguuugacucuaauuccuuacauuuuucaauauaauacuaucccuauccuauuuugugguauaugacuauucuaaucucuguauuuaaaauuuuuaaauuuaauaacuuuaaaauugcuauuuucaguuucuuaaaaggagauauguucauuguucauaaugaauuagaagauggauggauguggguuacaaauuuaagaacagaugaacaaggccuuauuguugaagaccuaguagaagaggugguaaguuuuguucuuuucuucucaauucuagauucuaaauauuuuauaaauuuggaucuuguccguaaucagagaaaguagcuaugaauacauuucuuuuauaaaagaacuuaauugauaaguacaagaauuauaagugcuguuuguuaguauggaacauaaucaggcuagcauauuauaauacauagcugccaauauucagaaagcuuguaugauuuucuaugaauuaaaaauauauuaacauuuguguuuucuuuugagacagagucuuggucuguuacccaggcuagagugcaguggcgugaucucggcucacugcaaccuccaccucccagguucaagcauuucucgugccucagccacccagcuagcugggauuacagacaugugccaccaugcccagcuaauuuuauauauauauauauauauauauauauauauaaaauuuuuuuuuuuuuuaaguagaaaugggguuuuaccauguuggccaggcuggucucaaacgccugaccucaaguguuccacccgccuuagccucccaaaguacugggaugacaggcaugagccacagugcccggccuauuugugcuuauuuuuguucuuuuuuuugccguccuuuucuuccucauaagugaaguuauaucagucugaucaugaaaccucaacugguuacacauguuugguuuuagauucuuuaucuuucaaauauauauauaauuuuccaguaaacuuggaagaauucauuuauauuauacauauauuaucacaugguucuacauuuugaaucucguccuuguuuuuguuuccaucauauaauacguuaucaugguaucaauuaccaggugcauuuuuaauaacaggucagcauuugaauggcuuuuauauuucagagacaauacucaguaucaaauauauuguacauuauaacuuuggaauucucccuuuccuuucggauuuuucuagugagauggaguggcuuucuguugucuuuuacagccuucaaagcuacuguuuuuaaauuaugccacagaccugauaauauucugaagaguauugcuccuggaagacugcaguggagaauauuguuuuuuccuauuaauucucuuaccugccuauucuggcaaccaaaucuugauccauagaaguaaaacauacugaguagaggugggaaaaguugaggaaauggugugauacaguccauacucauagucauauaguuauuuagugaaagagcuaggauuaggacuccuaauuccuagauuaguauucuguauucuacaguaaaagagauauuuacuccauauaggcaaacaguauucguacugaagcaucuuacuaugauaguuuuccuauaaaauuuguuaguuacaacuuuuaguuuggguuucccucuccuugcuguaccaccaucuucuccauccugauuacuucaagaaauugcacuauaguugaacuuuucuugagcucuuggaauucuggaucaaauuuaacaagauaaccuuuaaagaaaagugaaaauuacucaauguauacagaaaaauaauaauaacaacccaaaccagaauaaggagacaugaccucacaucaguacaagggaucaaggaaaaaguuagcaacucaguaugagugaauaaugugaugugguugcuaaaaaugaauauaguaacauuauaaauuaauaguggaguaauuccacgucauuuauaaacaauuuucacuccaauauguagaauaacuuucaugaugggcuuuauuagaggguagugaauucuuuguagauugaaaaaccauuuggacauugucuagucugugaagauguuucgggcauucaguuagugguuagauuuaaggaauuucuccuucuaaaauucuaauuacaguuccccaaacacauuuauacuuucauguauuaacucuagaauguaugcucucugaggggagggauuuuugucucugauucacugauguauuaccauugccuagaauagugucuggcauuaguaggcauucagaaaauguuuguugaguaaaugaauguuucuauguuuauaguuuucccucuuccuugacauucuugcccugauagauugccuuguaaaauuugauucaucuuuaugagcucaguucauaugucaucccuguuucacagaggauuuaugccuuucuggagucucuuaggcaaaauuguuuccuucuguauuuccauagcaccuugcuaauucugcauucuguuacacugucuaaaauuaauaauuguguaaaacucuucuacaagagauuaacuccuuuugggcagugacacaaugauaaugcuauucauuuuuauaguuuuuuuuuuuaagccuacucccuuggauauaguaacauucagugaguguuugauuuuaguuugauuagguauuuaaugagugaggaccaaauugugagaaguaaauccacauguaguuagaccauuuuucuccauaauaguggaaugaguaacacuauuguaucuuaaaucagaggaauauagaauaaaauaaaguucaaaacauaguaaaagggggaugucuuuuauauugaaaguagaaguugauguucacuuuuuacgggcucagaaugucuuacugaagagguagcauuugagauaguuccuucccagauugguuagguauuuaucuaacaaguagaaagcaaaaaguggaaaguacauucuaagaacaaaaaguacaagcuacaguggugggagauuggcaaauaggaaguuaugugugaccaugguauaggaaccaaaaaacaauugguaguaugagacaggaaauguagacuugaguccugugguaaacgacuucaguugcagaaugagaaauuuguaggcaguagagagguguuuuuuuuuuguuugguuuuucuuaauguagggcacagcugcuguugaaacugauguauccagauuagagugguggaguaggacauaauuauauuaguugggcuguuguuuaagaaaagucgauaagagggccugaguuaggguaauggcaacaagaaaagauuaagagagguuuggaaagauauuuacugaacagaaacaucuuuuuuuauauaaacauaaauaaggauaguguggggauauguuugcagauacgauuuucaugaauuuuaauaaaaauugauuaauaguuaauuauauaaaauacugucuuaaugucuucccuuuagggccgggaagaagauccacaugaaggaaaaaugugaguuuguguuaauuauuaaaaugaaaaaaaaaaucuauauuguaaauuuacuaauuggaaaacuuuggccaaaaaaauuguuuuuuaagguuuuggacugacuuaacuuuuaaauuuggcuuagggaacugauuucuaaauauuuucuuaaggaucuagugauaaagucuuguuuuuaaauaaaagguagcugauaacuaaauauaacucuuuuuaucaccacacugaagacuuugaauaaacacuacauuuauaacauuaugaaugucacaauuuggcacauuuuaaaauuauucauaguauuucuugguuauucauaguauuucuuguuuuauagccacaucuuuuauccccccaaaauaacgguucuucacaauuuuaauaagauucagcaaggucuuuuuuuuucauaaucuucagacugauuuuauguauauguaaguuuucuuuugaagaucugaaccauuaaucccaauucucucuuacucacauuuuaauagacuauucaucuccuaauaucuuuucaguacaacauuuuuucuuaucuuucagcauuuagggauggaacuugaggcuugccucaaguguuugcuuuuucuguuuucuaaccauuagaauauaaaaacauucaacugacuacuccauuugcagucaccuuguuuaaugcuucacccuucuguaaguggaauauguaagauauauucugaguucauuuuuauuguuucuuguagcuacaaaauagauuccauuagugagacuguacccugcuguuuguauuaguuugaagucuccucucuaccuauaucaggaguuucaaauucuuuuuuguuauuuuuucuuuuuuuuuuuuuuugagacagagucuugcucuguugcccaggcuggagugcaauggcacgaucucugcucacugcaaccccugccuccuggauucaaacgauucucugccuuagucuccugaguagcugggaccaccggcgcacaacaccaugcuaggcugguuauuguaccuuuaguagagaugcgguuuugccauguuggccaggcuugucuugaacuccugaccucaaguaaucuaccagccucggccucccaaagugcuggaauuacaggcaugagccacugugcccagcuaggaguugcaaauucuaauuaaugcuuggaagaaucagacagacaauguaagcaagugaagcgggucaaguauauauauucccaguuuucuuuagacacaauaaucuugaucuuucuuauuuucccucguugcuagagaucaagguacauggaacugugucccuacugucaaaaaacaacacuguacgugugguaauaaauggcaacuaauauucacucacgguguuagggaaaacugugggaaguagaaaacuagaaaguguuugccuauuguaagguaaucacuuugucuaguugucuaguugauauguguaggaaugugagucuaguguuguuagauccuucugauuuucaaaaaaagaccauaaaucuagguuuuuuuauuuuagauaauagcaauggaauuuuaaauuuaaaaauauagguuaaaugcuaguaaacauuuaaagcuacaucaguuuucucauaguauaaaauauaaaucccacuuucacucggaagucuuuuuaucugauagcauugucauucuuccauuuuucuuaacuuuauguaauuucuuaauuggggcauaacuuaaauuugcauuguugguuuauuuuauguguauguuuguucccuuuaauuuccuaauauagggacugucgcaguacuuuaaauucuuuaaaguguccucaguaacaucuacaaguaaccuuugagauuaaauagaugguauaacuuugguugaauuucuuuccagcucccuauuuacaugauaugggcaccaaguccugaugacuuuaucucuuaaaguauuucuuaaauguuuaccgccuucucaaaucuuaaauaacuacauucuaguucaggacuuuuuaaaucuccugccaggauuugauauaacaguaaccuccaaguugaucucccuugacucuuuagccucaucaaauccuuuuuuccaguagcuggaauaaucuaccuagauugaaucacauuauccuuaacugccagcagguauaugaaaaaaugcucaccauucauuacuaaucaucagauaaaugcaaaucaaaacuacaaugagauuucauuucaccccaguuauaauggcuuuuauccaaaagauaggcuauaaugaaugcuagugaggauguggagaaaagggaagccuuguacccuguuggugggaauguaaaugagugcaguuacuauagagcacagcauggaaguucuucaaaaaauuaaaaauaaagcuaccauaugauccggcaaucccacugcuggguauauauccaaaagaaaggaaaucaguguaucaaagagacagcugcacuccuauguuucagcaccauucacaauagccgagauguuuaaucaaccuaaguguucaucaguggaugaauggauaaagaaaauauaguacauauacacaauggaauacuauucagccauaaacaagaaugaaauccugucauucacagcaacaugaauggaacuggcaaauaccauguuaagugaaauaagccaggcacagaaagacaaauaccauguguucucacucauaugggugcaaaauauuagaaaauuaacucagggagauagauaguagaaugaugguuaccaaaaggugggaaggguagcagggaaggggggauacaauauggcugauuaauagguacaaaaauacaucuagauagaaugaauaagaucuaauuuacuggauauuuaaaaauaacuaaaagaguggaauuugaauaugccuaauacaaagaaaugauuauaugugcuugaggugauggauaccccauuuauccugacuugaucauuaaacauuauaugcuuguaucaaaacaucacugguaccccauaaaaauaaacaaaauaguuguauacauuacccauaaaaacagaaaaaauaaaaauuaaaaaauugaaucuuauacugauucuccaccuuuaccuuagcagagccuaaaaaaugaucuguuaucugguuauuuugucguuuacuacuccuagcacuuaucaucuguaguuuccuaaucuccagcauguaggucuucaaauucauaauacuuuuuucuuuauuguuuuagagauagguucuugccauugcccaagccggagugcaguagugcuaucauaguucaccucaaacuccugggcucaagugaucuuccugccugagccucccgaguagcugagacuacagguguguaccaccacaccuggcaaauguuguaauuuuuuuuuuuuuuuuuuuuuguaaagaugaggucuuacuaugcugcccagacuggucucaaacgccuggccucaagugauccucccaccuuggccuuccaaaguguugggauuacaggugugagccauugcuccuagcuauuuuucuuuauaccuuugcucaagcugcuuccuaggccagaauucuuccauucauacuuagcucauucaucacuucccccuagaaaaucuuccuuuauuuuccucucuacacacucaacaguauugguacccuucucuguuacucccaaaaugccuuuggcaauaccuaucacugugcuuauuauaguuucuacauuguuucuauaguuagggucucacuauguugccaggcuggucuuggacucuugggcucaagagauccuccugccuuggccuccgaaaguacugggauuacaggugugaucccaguucccacgccuggccuaggaguaggaacuuuauaagagcagggacucaucuuuuuaucacuguugcaaaccaugugguugaaauauauaaauuuuauaugggaauaaaugucugaaaaaugaaacgaaaacucuuuagaaagagauauugccacuuuggcuucagacugugugcuuaugcuaaauaaucuuguucaucuguaaacccuaucacuuuuuuacccuucuuuuuuugaauuuuuuucaaacuguagaaguagaggauuagccuuggaggucaggucauguaguugacuguccuccagaauauaaaaauccugcucuagcauuuguaguaaguggucauuuagccuauacuugaaugcaguauagaaccucacuacuuguagucugaacuguuuuaguuguuguauucuugcuuuauauuauucaaaauuuacacagggagcaccaggagaucugaaucagugaguuaaugcuuggaaugguguuaaagaaaaguuuaccuuuucauucaugugaaaauuuaaaaauucaguuauauuuucauacuucaccaguaauaauuguauggaucauuuaaaacaaugugaaugaccucugaaccugucacacuggacuuuugagcacuuauauauuuuagucguauauuuacuuucuagcuugcucuuuauuauuaaaaauacuuguagacccuaagaagaucccacaaaguaguagauaggugaucgggaauugucagccuggcauuaagauguguuaaucagcaagauagauaauaggccuuuagguaaauaagaggugauuuuauguacuuugaugacuaguaauuacuuuuuaaaucagauauauccuuuuauuugaagguaaaauuuaaauacuuagguuauuguaugcucuaugucuugacuaugaugccuuuuauaauaauuucuaaaggcuuaauuuaagaauacagaauauaaaauacauagcaaccuaguuugauaggcuguuagcucaaauagaguugagaacacuaaguccuucuuuucuuucaguucuugauggugcuauccacucauucuuaucacccaaucuuauauucugacuuucagcaaaguaagagucaauaucuugauuuuauuugaggagagaauuuaucagauguuauaggaaaauucagaaaugaauucauuaauuuuuucagggaaguucuggaguaggcucuaucuguacuacuccuccuuccccuuaccccacaaaaagaaaaaaaagaccuauaacagucuguuauuaucaggauuaaaaauuguugccauuuuuguauugguaaugaaaauuguaguuuauauuugauaguuucuaguuuuacuaucuuuaguugaaauuaaguauaauauguauauaaaauguauuaaaauguaauaagaaugagaugauuugauuaauugcauuuauuuuaucacuuugaauuaaacuuacuauauugguuguuuaauuuugaucauaugauaacagcaaaaaggacuuuauuuauauaucuaauuuauucucuuuuuaagaugguuccaugggaagauuuccaaacaggaagcuuauaauuuacuaaugacagguacuuacauauuuacuugcuuuucuaaugucuauuuaaagagaauaaaaaagugaacaaaccauuuaucauguguuuugccuuuagcauucaguuaguguuuaugcauguuauaauuucguguccaguacuaagaagcugguguuuuuauuuauauuuuaaacauacauguguuauaaaauuuagucaaguguguuuuucuuuuaccccaggccccuguccacuuccucagaaguaacacuaggugacaguuuuuuuucccauauguuucuagaaguuuucugugucucugugaaucuuucucaccccuacacauacacagacaggaacaugcaacacacuuuuuucauguuagauauauauugggagaugauucuguaucugcagauaaaaacuuucauuacucucuuuuauggauuuaaacuuuucauuauauaaauaccauaauuaacuagucuucaguagaacgauauuguauuguuuuuauucuuuugcuguucagcuacagcagacauucuuguauuuaucuuuguauacuuguggaauuauaugauugagcuuuauuuaguauguauuaauuuuaacauuucccaaaacuguuaugcuuauaaauacaaaguaaaaauugacuuguauugugguuuuaaccauccugucauuguuuauucuuacuaaauauuuaaggcugaauuaauuuaaauaccgagcauuucuuuggcaaaccacaucuuauaaagauuucagacaaguuuaagcuuuaguauguaauuuaaaaguuucaguucuucaaaaauguugacuauucaauaguuucuauauuuggugaaauagauucuuguggugauaacccuaauuauagagguaaucugaauuguuuuaauccauaaagcacugcauuuuaaauuaauacuuuauucuuuugaaagauuugagauaguuuuugaaguacucaauuuuauugugaagcuguagguuaaguagguucaaaaaauaaguuaaaaaagauuaugauaaugcuauaugauaguaauagagaagaaauuuuaaacuaaaaugacauucugucagcuauuucaguguggaaccaaaaauauguaguuuagugaauuuauugaauuuuggauauguuucuuuuuuggaacuuguaccaccaaguacuugagguacuuuuguuuuaagucauacaagguugaaaaggagcuaaacuuaauuuccuuaauacauuaguuugcauuuucuuugugucaugugcucuuuugaggaucuggugggauuuucucuccugagaaguacaaauaagcacuugcaugcacagucuugcaugaaauuccuaucauauucuagaagaaauuuagagaguaucuuggauucuugucaguaagauuuguuguaucaacuuagaaacacuuucauuuuagcccauauuauacaaucaauuucuguaauuuuuauguuuacuuauguauuaagccuugaagauucaguuuaaggagauuuauuuuuuucuuuuuacugaacaugaaguuacuucauaagugccuugauuggaugauuggaacuauuaguaauuuaccccucaaauuauaucuaauaaucuaagcauucauugugcuuuccuaaaaacaaucaaguccugaucuuuucuggaucauuugaacuuaaauggagaaaaggcagagcaucuauguauuaugagucacugccaaucaaagauaucagaaauacuucucuaaaauuaaugucauauuuaauauaugauaauuugcuucuauaauuccuuucaggagcauaccuauugaauaaaauauaguguauguguauugauuuuugauaauguauacacauauuucaguuguuuugaaucuaccuuuauaaaaagcuuuugguacuauuuuauuacaguuauuacuuuuuaauuuuuuuuuuuuuaagaugcaggaucuugcuguguuguccaggcugguaucaaacuccugggcucaagugauccuccuggauagcugggauuauaugcauguaccacugugccuagcacagucauuacuguuuaaugauuaauugaaaacauugauuaagcacagaguauucuuaagcaaacuggucuucacuuuuuagaaucuucuuauuacgaagauuuacauacagaauuuagcaguuuuagccaguauucccuaacuaugcuuagguuccuuccaaauuaggacagguguagauauuacugaccagaaguuacugcugcaaaauuucugcucucuauuuuuauguauuaaagcugguaagauacaccagagagauagcagacaagcaauguggaugguugugaaucauaaaccagaaaauuugaaagaaauuaucuuaaaaaaaaaacaaguuccuggugaaaauuuacauauguuuaugacuuugaaugcacuuuguaauaauacuacuuaacaucuuuucuuuuuuauuugauaauuagggaaaaacuaacagcuuaauucuuacaguuggucaagucugcaguuuucuugugaggcccucagauaauacuccuggcgauuauucacuuuauuuccggaccaaugaaaauauucagcgauuuaaaauauguccaacgccaaacaaucaguuuaugaugggaggccgguauuauaacagguaaaucauaauuuuuuagcuaucuuuuacuuuucgcaaaaauaguugaaaucuugauaauacaguauucagagucaaaauuauauaaaaguuucuaacuucuaaaaauuauaagaccuucaauauaauuucauaguagucaugcccaagaauucuuuagacagugucaaauaugaauacaaauuaguaacuuauacuuuguuuccuuccaaaacaauuuuugugauuuuaaaaauuagacauaagcuguuugcaacaaauuuacuaaauccauguguuaucuguaggaggagcaaaauaucuuaggaaaagaaaauauaucaacauuauuuuaucagugagauacuuuaguaggaaaaaaaaaguuucuaaagauaccugagacuuauuauacagauguuaucauguaacugaguucuucucaaguugacauuucuuacaugugauuguugguuuuuacuucucacuuucaaaguaaacucauuguuugucccaaaacucagaaugaauuauaguuacuugauuaggaaaauaaguuaauagaagaaaccauaugauagaaugucagcaauuuuucagucaaauagaaaauaaucuucauuugugaacguaaagguuuuccuauaacuaauaacucucuauuuccuauuucagaggcuggcauaaucuuguucuaaaaugcuuauauuugccuaguuuaaccccucaguaccacagcaguauucucuaucugaauuagaauuugucaaacuagacauuugagugaauagagauucuguagcuuguuuaucugaaaaaaaccaaaaaacaaaaacaaguucuucuaguugcuugcuggaagcucaguugacuguuaaaagacaucaaauguaagaugugagucuaggcagcuguacccuuuugccuaccucauauacagguugcuugaguacuuuauacaugacaaucugaguucuagauguccucacugaaaauacagcuagcugcaauuugaguucuuuaagaauguaauuuuucccaauuccaguuuucuggagauuuagaacauacaaaauaaugcacugaaaauauaucaucuucuuaacugaauaaauguccauauugagauccuuuuuaaagauaaaauaauuuacaugaauuuauuuuuuugaaguucguuuuguuacuaacuuaaacuuccuuaugauacaucacacaaaacuggaaauucuuccuacauacuggaggaagucgguaaaacauguaaagguagucgcuuuugguugcugaacaccaugauggaacaugaaaaaagaaguauuuuaaguagauuucuguccaaauuauugcaauauuauguuuucaaaaugaggauuaaaaaaaaaaaguuaaauguauguuaauuuaguggccuugaccauucccccagaacuuugauuuuuauaauuuuucuucccugugaauuuguuuauaaauucaucuuauuguuucuaguuuuaacauuaaacuucuuuaaaaagccccaaauuaugugaaucaggugcugugaaaaugaaggauuuuguaauuguuuuggaaauauauauuucauuucagcauuaauguuaguaaugucagaaauaauuccuaggaagauaaaucuuugugcuuauuguuuauuguuagaucuaaauguauaaagaaagauuuuucaauaaaucugucgaacacagccauacucugcugucccaucuccccauuaacuaaacaugagaccuugauaaagagggauaguaguuaugucuuucauuuagaaacuguuaagacauaacuuuaauguuccuauauucagaguuuuaaaaaaaaaaagcagaagaggcauuuaauagcaaauuuaauucagcagccauuuaucgacuuaucuacuuugugaaauauacuguacaaauucuguguaaauacauuaaagaaaaagauauaguuucuucuuuauuagugcucagguuuauuagaaaagaaaguaugguaugcagaaugugauaaauucaggggauauauaaaugcaugggaaucaauaaaugagaguucaguggggggugagaaggaagacaauggauuuuggcuagaccuugaggagacaauauuaacauuuaucuagacuugaagaagaagagugcacaugguuuuaugugcuaaaugcauuacaaaaauuaaaauacagaacacagugucucuagaaacucacguuuauuucaaaaguaaguuuacauugaauaugcuuuaguuuucugagauguaaaucugucugauuucauggcuggaacuuauaugaaugucuagaaaauucugguuuaucuccccugacuguuuauuucgguguuucugcguagaguauaaauggaagaguaauuuuuaaaaaaacucuuaagucuagcucauugguaaaaaccuaucugauugguugccacacacuuuuaaauuugcuccuggacaaucugaacuguacuuccccaugguuuccuguucucucaguuuaugaaaaacaauuauauuguaacauugaggugcuacaguggauugauuguauuuuacaguuacugagcccaaaaaccuuugauguuuacugauuuucauagauuuggugcuuuuugcuuuaaaacacauagucaucucuuuaguggaaucuagcuaucuucaaauauauuuccugauuuucauuuuucuuuuaacaauuuuggauuuauaugguauuagauuuuuuuauuaaaaacauaaaaucuugcuuguucuuuuaauaaugcuuuuauuuaucucauuuucaccacaccccucuguggcuuguguuaaaugcugcuucugguauuaaguucauucauacacuacuaguuaacuuuucagguccuuuuguuuugguuuuuaacauuacuuauauuugguuuaaauuaacuuuguaguauagggaagauaacauacuugaagauacacacacacacacauauauauucuaauuauauauauauagaagguuaaacaaaaucugucuggagaaguguuuccuagguggcucaaaaguucccauuuguccaguauauuaaaggaagguuuaaaauuccaagauuuccauauucaggacaauagaaugaucuuacugauuauagagaaacaacuuuauauuuaaaaaaauacgugguucacuaaaauuuauauuaaaauacaguaugucauuuuauuuuuuuguaauauuuucccaauauuucccaauuuguagcacuuuuaaucaaaauaauaagcuuuucucccuauagugauaauccuacauguaagauuagcuggggguuuuuuucuucuuuuugccugcuuuucauguguuuuaugaccuguuucugauauaaaaccaguauguguaaaugugauaauaaaaauucuuaauuuaccugaacucugcuuccuaaauaaaugccauguuucugugaauucuucauucuuaguaucucauauauacucuugggggugaaaaaaaagguagacuuuuaaucauuuccucauuuauggugacucuuugaauaugguauuguugaccuggcugcccacuugauggguauggaaaaucagaaucugggccauguauucuggccuguaaaucuauauugagaacauuguuuuuucuaaaauaauaugaauguuaugaucauuuauucuauuaauguauuuguguuaugugcuuugaaaaaaauuugcuaauuagauaauccuuggcaagaaaguuuacacauauuuuuaaagauuuugcaguuuuaugagacagauuaauacuagaaauuuuuauuuuaacagcauuggggacaucauagaucacuaucgaaaagaacagauuguugaaggauauuaucuuaaggaaccuguaccaaugcaggucaguguugcauuucuuauugcaauaauuagcauuuuauuuuaaaaugcauuuuggugguauguuuuugcacacauuuguacaauucaaauuggauacaacuuaaaacuacagauuauuuagauuuuuuuagaaagucaacuguaagaaucuuuuaguuuuuaucuauguugauuuuagguaaucaggaacaaccuaguggcuuuuugagauuagaagcagucguggaggaagguaaguugcaguagguccaggagugaguuuuuuggaggcaaaaguagagacagcagggauaaaccacagccaggauuauuaaagccuggggaguaauaaaaggaaauaaaaaauacugauagaagaggauuagggcaaaaaaugguuuacacuuuuucuuuguuuauuugccuguaguuuuacggugagaggauuugagaaugucuguauacucugagugaaaacuguauaguaguaaagaggagagugaaguuguauggggagaugggugguggcaaugucuuacagacaggguccuagacaaaagugaauagaaucuagaacauaaaaggaaagauuggccuugagcaagagagccuguuaaauguuaguugcuuaacgcuuagggugauuagcuucuguuucuuccucauugcacuuucugaaguauaugguagggaaaugguauaacagggguuagaaaaaggugcuucaaaagacggauuaauaauuuuccuaaguggaaaauggagguacuguuauucuagggacauaaaggauuauuaaggguuuuggguacccagcugcaauuguacagugauuuguagugugccuaguuucuugauguuuccuccuaacaaauucauuucacauggcuauagcuacuacuuauugcaguuaauuggugggggguggggugggaggugaggaaucauuaaucugaagcuaaagauaaauucaagaaucauaaucuugucacauuuuaacauacaggcacacuucauuuuauugugcauugccuuauuauguuucaaagauaguuuuuuuuacaaauugaagguuuguggcaagaaggacgucuauugcgacuguuuuuccaaagcaggugcucauuugugucuuagugucacauuuugguaauucuuaaaauguuucaaacuuuuucacuauuauauguuauguugaucugugaucagugaucuuuaauguuacuauugcaauuguuuuggggugccaugaacugcaucugaagaagacugcaagcuuaaucgauaaauguaguguauguucugacugcuucauugacuggcugguucuguuucucuuccucuccuuggggcuuccuauuucugcagacacaacacuauuaaaauugggccaauuaauaacccuacaguggccucuaaauggucaagugaaaggaaaagucacaugucucucacauuaagucaaaagcuagaaaugauuaagcuuagggaggcauggugaaagccaaaauaggcugaaagcuaggucucuugcaccaaacagcaaaguugugaaugcaaaggaagaguuguugaaggaaauugaaagugcuacuccauugaacacaugaaugauuaauaaagugaaacacccuuauugcugauauagagaaaauuugaguggucuggauugaagauuaaaccagggauaacauucccuuaagccaaagccuauccaaagcaaggcccuaacucucuucuauucugugaaggcugauagaggugaggaagcuccagaagaaaaguuggaagcuaccagagauugauucauaagauuuaaggaaagaugcuaucuccauaacauaaaaguguacggugaagcaaagaaacuguagcaaguuacccagaacaucuagcuaguuuuccagaagauaacuagcaaguuauccagaagauaaguauugaaggugcuaaacaacagauuuucaguguaaagaaaacauccuucuaucugaaaauauuaucuaggacuuucauggcaagaguuaaugcuuggcuucgaagcuucaaaggucaggcugacugacucuuuucaggggcuaaugcagcuggugacuuuagguugaaaccaauuaucguugacuauucugaaaauccuaggagcaucagaauuaugccaaaucuacugugccugugcucugucaauggaacuacaaagccugcaugauagcccaucuguuuacagcaugguuuacugaauauuuuaaggccacuguugaaaccuacugcucagaacaaacaauuccuuugaaaauguuacugaucacugacaaugcaccucuacaaucaagagcucagauagagauguacaaggagauuguuguuuucaugccagcuaacacagcuuauauucugcagcccauggaucaaggaguaauuuugacuuucaaauccuuaguuaagaaauaauuucauaauguuauguuugcaaaaaauagugacuuauggaucugggcaagguacauugaaaacccuuuggaaaggauuuaucauucuagaggccauuaagaacauuugugauucaugggcagaggccaaaauaacaacauuaacagaaguuuggaagaagcugauuccaacucuuuuggauaacuuugaggggcucaagacuacaagaugacuuugaggaggagguagcugcagaugugguacaaguagcaggagaacuaaauuuggaaguggagcuugaagaugugacugaauuacuccacuuuugugaugaaacuggagcgaaagaggaguugcuuguuacggaugagaaaagaaaguggucucuugagauagaaucuacuccugugaagauccugugaucgcuacugaaaugaaaacaaauaauuuagaauauucuauaaacuuaacuugauaaagcagcaagaggguuugggaggaaugcuuccaguuuugaaagaaguucaacuguggguaaaaugguaucaaacagcauuauagggaauuucuuuugugaaagaagagucaauugaugcagcagacuucauuuuuaagaaauugccacaaccaccccaaccuuuggcaaccacugcccuaaucacuuagcagacaucaguaucaaggcaagacccuucaccagcguaaagauuaugacucacugacguccuagaugauuguuauuuuuuuuuuuuuuucucccuccggagucagggucuugcgcuguggcugaggcuggaguacagugguucaacuguagcucacugcaaccuugagcuccugggcucaagcaauccuccugccucaggcuccccaguagcuaggacugcagguguacaccaccgugccuagcuaauauuuuuuguagagauagagucuugcucuguugcccaggcuagucuugaauuccaaggcagaagccuuggucucccaaaaugcugggauuacaguugugagccacuuugguugccccaacaguuuuuaguaauaaaauauuuuuaaauuaacacguguacauuguuagacauaaugcuauuacacacuuaguagacuacaguauaguuguaaacauaacuuauacgugcacugcgaaaccaaaaaauucauauggcuggcuuuauugugguggucuggagccaaaucugaaauaccuccaagguaugccuauauuuuccuucauucccgcaugcuuuccuaguagaauuuaaggucuaugagaacagagauuuuuguuugcauuguuuuuucccagugcuuagaacaguaccugacauuagauauucaauaaauauugauugaaugaaugauucucugcuuuccagcaagaaauaccuacuuuacccuugccuguauuguuacuaaggucuuacacuuuaaugugcuccuuccuaucaccaugucagucuuccucucugccuaucuaaauacuauuuuaacauccaucuuguuucacuuuuugaguaauuuuuuuuuuauuaccgcagaguaauuggaagagaaguuagccagaacauauaacauacacacacauauauaaauauauauauguuuuauauauguguauuuuuuaaauaacaugggugagugcuuuuuagaccauggcuaggaucuuuuuucaggaucagaggugccuuugccuccagaugacggauccugccauauaguuccauugcuguauccucaauucuaauuccccuuggcucuuugaguuagugauuuuaauuuuauuugaccccaaauuaaaucauacauuuccccauacugaauuuguacuuagaauuuucuaauuuaaguuuugaucaagaccauccuggcuaacacggugaaacccugucucuacuaaaaauacaaaaaauuagcuggguguggugacaugccccuguagucccagcuacucuggaggcugaggcaggagaaucgcuugaaccugggagguggagguugcagugagccgagauugcaccacugcacuccagacugggagacagaacgagauuccaucucaaaaaaaaagaaaaacaaauaguauguggcaucuaauaaacuugcaguauguguuauaagacugcuuuaagaauuacuugagauauguaaugugccuugcucuuguguuaguuuuauaacugaacaaaccuccaauugguuuugcagaagugccuauaaugcuuugaauacuucagaaauaauugaugcugauuauaaagcaauuugauugauugcuacacagaaacuauuaagugcuauuuguagucuauuauuuuggagcauggggugaugaaaaguugguuuuaguagaaguuuggggaauaauaaaacucacucauucuucaagcaggguuuuaacuauuaguacaaaagcaauacuaucuuuuuacuaaucgccaaauugauuaguuagcaaaucaccucaucuuccaaugaggugacccuguguacccacacucaggcuaagaugcuggcaaaggcuaagaaacagcagaguccuagcuagcuuugcuuacuuccuggaacuguuaacacuuuuugaggcaagcauuagacaaaaaggguccuuuugagacaauauaccccauaauaaaaaugccuuacauuuuugagcacuauauuuuaagcacuguuuuuuauacauauucauucauuuaauuuucucaacaacuuuaccaaggugacacuacaaugaugccuauuucaaagauaaggcaacugagagcugagagguuaauaacuuaaaucauccucaauucuucucuuuuuuucuuccuguacuuuauaucuaaccugucaggaagaucauacugacucugucuucaaaguaugucuagaauaugaccaccaccagaaucugccuucaucuccuaguuucuagcuuuguccccuuaugcugcaugcugcgcagcagucacugggauccauuuaaaaugucagaucguguuacuccucuguuuuaauacuugaaaauguucuccauuucuuucagaauaaaagccaaaguccuuagaauggcauacaagacccaacaguggcaguccauuaauuuucugaacucgucucuuccuacuauccuccugccacucuuuuucacucauacuugcuucuguauuauuauuuguaaauaagccagacucuuuccuuccuuaggaucuuugcuguagcuguucacuguguccaaaauuguuuucucuuggauauccacuagccucacucuuacaucuuucaaguuuuugcucaaaauuuagcaaauuagcaaaugacacuuuaccuagacaccuuaauuaacacugcaacuugcucaacccugcggagcacuuaccuucuaacauguaguacaauuuauuuauuuauguuuauuuuuaaucuuucccugguuagaauacaaguuccaugaggauaggggucuuugauuuguucacugauguaucucaagaacuacaacagugccugagacucaacauuuauugaauuaauauauuaaauggcguuuuccuacauuaagugacaaagcuaggaucugcaaguuaagucugucuucaggagcuuacacauguaacuucuagggaagagcuugguucaauggcuguuagacucuaaccaaucagauuacugaauuucccuugggaggaauguaaaaaaucuaagaacuaucucucaggcugagaaaaggaacacguagagaagccuuucuccucucauugacuaggacuugaaaagugauguuguguuuuugcccauagcaucuucuaguguauuggaaucuuuuaggauuugugggcuaguccccacuuuaauaugauuuuuaaaagaucuauauagauuccaagaucuauauaaaaucuuggaaucaaguauuuaaauccaaauauuagugugguuacaugucuuaaaugacagacuccaagaauguuccauucugcagcuaauacuaagugccaucaccauugaacuaaagauuugauaaauacaaaucuguauuaccaggaaaguaaagucaucacuauuuguaacaucaugguccaguguacccuuuuaauuuuuuuauauuccuaagucauuuuacaaauaauucgcaucaccaagauuaaggguauaauccaaaaacaacuucauuggaaaauguaguaagaauuuaaauguagcguacccaaauuuuuguuccauguuuucaugucuagaaagguuuacguaccugaaauggacagucuuuucaaugcaacuaacaguucuucacccuucgugcacagaccuggaacacagccaucuuguaaacucugauuccagauuugaaaucagauacuugucuaauaaguucuauuuguaauuacuuugguucuucuugcauuguaucuaucauaucaauuccagauuuuaaguacaucacuacuggaaucuagcuuauucuuucuuguuuuuguauuaucaaaaugcaguuuuuuuuuuuuuuuuugagauggaauuucgcucuuuuuugcucaggcuuggaguggaauggcaugaucucagcucacugcaaccuccgccuccuggguucaagcgauucuccucccucagccucccauguagcuggaauuacaggcacgcgccaccacgcccagcuaauuucauauuuuuaguagagacaggguuucaccaugucggccaggcugggcgaacuccugacuucagaugaugugcccgccucggccuccuaaaguacugggauuaaaggcgugagcaaaaugcaguacuuuugaaaacucugauggcucauaauuuuguuggagaguacaguguccauugcuccauaauuguaaaauauuuuuguuuagauuuuaaaacaccaguuaacauugauguuuauaagagugaucaauccagugaauuuuacaauuucuauauguuuacuuucaguaauuuuuuauacaaaggcccuuuaauauuugcccauucacaaaucauauuaaguaaauuuugauguacauacaaaaauuuagucucauuucuuuuuagcaaaacaggauaauagaaguaauaugguucacucagugauugaguuugagaaaauucaaguauaucaucaucugaaaaaucacagucugagguuuaucaaaaucaauucugccaucaugauaagagucuagagugcugcuguuucuuugcauucguuuucugauuuuucuaauugucaaacaucuuccuggaucaguuuuuuucucuuuaucauuuaugagcagaaaauaaagaguucugaauauuuuaaguauguucaaucaaagcuaaaaagacagcaaagauggccuuuuauguuuuuacaaaagaugccgcaauacuuugcaacacaguuacacacacacauacacacacacccagagugaugcaguagagauuauuuauuucaguuauaucauccucuaggccagcgguuggcaaaaguuuucuguaaaggguuuugcaguucauuuaguguguccacuaaagucugucuuuuuaucuggaagcaaccacagacagcauguuagggaaugagcauggcuguguuccaguaaaacuuuauguauaaaaaacaggugguggacuggauuuagcaugcgugccacaguuugucagcccugcuguaagcaauucauucuucuauuuucuuauuauuuuaguaauuuuguagcauuaacuugggaauaauucugaguaaugaugaaauaguuccuaggaugaugaaacagcauaauguuucaagauagaggauuaugaaaaucccacagcauaacuuagauuuauaagaggauugaauggauccaugaaguuuguaagauggacuaaaagucauaaaauaugaauccuugcaaaauaguaagaacuacucaaaaaggaaaccaaaaaacuaaaacugaguccaauugaccuuaauaguaaaauugaagauucauuuauucuggaaagaucaugauaaaggcauccugauauaauucuuuuccucaggagauuuagcaauuaauguaaguucugcuauaauguaacauaugcauuccuaaaaaucauagcauuaugcaaaauuaggcaaucaaaaccacagggcuuuugagaaaagugagguuagggguguuaacacuuagaaauuucaucagggauacauuaagaaagaaccuaauauaaauauguugcuuaguuuuauacauuuuuuuuuaagaaauauguacauccuacaauaaauauggcaauuuaccuugaaaaaagagguacauuacaugaggaaauggccauugguagaguugaagcaugggaauguugcagaguggcagaggaggauuaucugaaaucaugguuauaacaccagcuguggauggauggguguggcaugugacacacuuaguggauugagggaacuguuagguauuugaaguguguauguuuuguucauucucaugucuuaguucaccugguacgguugucuguauucaccuagcauuucucacagacacaauugugcauaggcaaacaugaauuugcuuuaugcuuacauugguuccuaaucuaccaguuaugcugggacaaguuuauguuuuuaaaacaugauuugcuguaaaauauaacugacuguauucgaaaauagcuuauuagguauccauggaaacagacaacuuauuaguuguucuugggauuggcaaggaaaccuuucugugaacuuuguugucgguguucuucgaaauuauaaggaagcauuucugagaauuucuuuggaaagcaaaagaucauuuauguguuauguguaucuagauuuuaguauuuuaagcgcuuuggcuuuuaauugguacuuuuauagauuuuuacuucauuuccaucaagaauguaugaaauaauuuuaauguuuuuuaaaauucaggaucaagaacaaguacucaaugacacaguggauggcaaggaaaucuauaauaccauccgucguaaaacaaaggaugccuuuuauaaaaacauuguuaagaaagguuaucuucugaaaaaggguaaguucagacuuuuaucauuaacccauuugauagagacguuguaaauauggagcuccgaacuuauugugauauauauuuaauaaguuuugacaugaguuauuaguaauugacacuuguuuagagcccauauauaagcauucuucaaaauuuagaguguagguauauuaaaagucuacauuuucaaccagaauguuucuucuacccaugguuucuuuuuuucuuucuuucuuucuuuuuuuuuuuugaggaacuccuuauggcacauggcacauucauaauauugauauuuuacagauuuaccucaauuugacauaacgacauuuuggggaauugugggugggggugugcuuuauaaaguggaagaauuuuuuccuuaagacuguuaaagaauuauuccaaaacaagaauucugacaauuucaucaugaugaaaucucugaagauauaguuaagguauucucagcauuuacucugugauuaaaacaaguaauauaacaaaaggcauuuuuguacagauuuguuauaggcauuuucucauuauguaagaauuggcauauuacauaagcuuuggaauaaaaauugauugauucauauuuuuagaaacacuaauuuuaauaauauguaggauuucacaauuguuuggcuaagagaaaacaauuuuuuuuuuuaaacaggcaaaggaaaacguuggaaaaauuuauauuuuaucuuagaggguagugaugcccaacuuauuuauuuugaaagcgaaaaacgagcuaccaaaccaaaaggauuaauagaucucaguguauguucugucuaugucguucaugauagucucuuuggcagguaagagacugguuuccuauuuuucuuucggaauugucuuaauaauaaaauaguacaaacaaagcaaaccaauuuugagagcccuaaaaucaucuucuaaaaguagcagaugcacuuucuagguaauuuuugccuuccuugcuuaauuguagacuaauauauacauaaagucuacuucauuguguugcacagaaaucuuuggcaugacauuuccuguaguaaagcauguuuugucccugccccaacaagcaaucuuuugagugacuuacuuugagucuuugucaccuuuccucugauuuuuucacaugguuuaacucaguguacccaagaguacuaggugcacucaauucugcuauuaacucuauaagcaaguucuuaagaaaguuaauguuaaaaaauaaucuuaaaauugucuugauaggaaaaauguauuugaaauuaaaaaaaauucuuauguugacuucuugguuuugaaacaaugaauauaaauguauaagcugaauccuaaacaucagaagacaaauccagcucuugauuacaucuagauuuuuuucucaagaacaauggccuuuaccuuucaccauuaguauuaucaguaauccaucccagucuuuuuagauguacuuaccauuuuuauuaccuauuguuaugauuaguaagagaaaagacaguuaaauguuucaacagcuuguuuuucugccgcaggauggcauuucugugaggcaaaucuacguuuuauccuguugaaauauuucucuucuuuaagagaaauaccuguaaaauauauagccuugucauuucuuuuuucaguguguuuaggagaucacauuaguguuacuugugauuuugacaguuuuuuaaaaugaucaaauagguuugggaaaugcugauugaacaaauaguuuuacuuauagcaaggcuuuuuguagcuuuagcuaguguuuauauugugaaucuguaaaauaguaugaauuacuucauaaauucauuuuacgaagauacccuuuuuuuuccccugaauacucacugauaccucauaaagaguuguuccaaaaaacacaaagauugcgugaggacaggauuucuugagauuuuucugccccucuuuaacaaccugagaaucuuaaccuucaaaugugguugauucaggccucugucuuuucuuuuuaguucuacucugcacccuucuuguggguugaauccuuccucaaaccaguucccuacaugguagcaagguagcaaacagcaccagagaaagggcuguaagcauucacucccauaauuauuaaaaaaucuugaaaacauucuguugagccaccucucaaccaauuuuuaguucuggguuacugagguagcaaaaggaaugggauuauccugauagaaugaggagacccuuuugugccuagaucuguugcuggaaaugaucucacccaaauagugaggcugcucuacuuaccauauguaugggugaaauggauguuggagaggcaacacuauucacuacuaaauguaguuuauuaucgugaaaacaguuaaaaacaguaaaaguagaauauuuugggaacaauuuuauugagaucaguaauaugaaauagguggcucuugauucuuggaggauggguaugaauucaguuggauaguugagcagagcuuccuaaccaguguuccauuaaucaguauagguguccccugagauacuagugguuguaaaauccuauuguaguagagauauuuaacaaauguuuuauauuucaaaaauuauaacacucgaaaucauaugaucccuguauaaacuguucuaauucauuauuuuauuggggcaaaagaauugaugcauaacacuuggagacagagagcucuuuauaguggcuauaccucaguacuuccuacuuucuuguucaaucauccagguacucugaauauuacuuuauucacagcuucauuaugaagcuaccuuuuauguucaagcagaaaugucucauuuuguuucuuaccuuuuuucgauuaacagagaaguuaaaauuguuuuaauuaucguaaaauauauaaggagguucuugaaaagaacauaaugaauuugauauauuuuucauuuuuacuacuuuauaauuagccuuaauguacagauguuaauuuuucccaccauaagggcaauuuagugacuaacacuggaaagucauuagacucauaagauaaaaaauaauuuuaaaaaaauguaacucacuuacuaggaccugaaagaaauacauuuaauugcuaaauuuuuuuuuaauacuuugaaacaaagaagguccuauggaaaugcuaguuaaguuuaugacugaugaugaggcuucacgauaggaacauuuaaagauuuuaugucaagauuauauauauguuugucuguagaccugaauuccauauuaaauaauauaaugaaauggaggcuguaauaaaaucuaagcugcuucaguugcauguguuuucaguuuuaggugagaaauggaaucaaaauaccuacuguuggaugcugaaguauguuaccuguccaaaagaaaaguuuugauaaaaguuuaugauuauaggagaaaaacuuuuggugaaugauucucauuuugcagauuuacugaagaaucaguaaacuucgucaaauuauauguacaauacaaaaagauaugugucuugacaguuuauggauuuaaggcagaaauucaaccuuggaaaaaugagguuaaaaaugauucacuaaugauacuuacaacugcaauuagaugaaucuuaaggaaguauuaagaugaauauugcaauaucuguaagauugaagaaaagcuuuagcauuauuuugauauaguuuauaugaacagaugcaguuagauuggaagucuguuggcacaaucaaaagaaagguccacauuacacuugaugguaaaagagaaagaauugccagaguaaaaagaaggaucagauccuugaagcacaaguugaagauugugaaugauuccuauucugguuaguaacaagaaaggaguuucugucugguagggggaaagcaauaaauauacauuuaccacuugcuguaagguuguagcuugcuucuuguacaguuucuuguugaaggugacuuaaagaauuugaagacauuagaaaaagucuuuguaaugaauuauauuuaaugauaccaggucugaaaccuaguaugaaaaaguuauguucaugagaacuaaacucaagucucucauuuagaaaacagauuuuucuuuuaagacugggcgcaguggcucacgccuguaaucccagcacuucgggagcccaaggugggcugaucgcuuaagcucagggguuggagaccagccugggccuacauggcaaaccccgucucuuuaaaaaauuaaaaaauuagccagguguggugaugcacaccugugguccuaccuacucaggagagugagguaugaggauugucugagcccaggcucacaacugccaggauguugcagugagcugacuguaccacuacacccauggcagagugaggcccggucucaaacaaaacuaaaccaaaaacaacaacaaaaauuuuuuuuucaaaguaugcuacuuuauuauuaacuauuuuuuuuaaagugccuuccugugaaauagagaagcacuuagugagaaagacugaaugccaaggcaaauagcauuaacaaaguacauuucaaggaaaugagaagacaucuguaccauauaauaggacaaguagaaaaauagguugauaaauuauguauuaccauaggaugcaaauaccagaggacaaaaggggaaauuauaaaugaauguuaauaucuuuuucuuuauuaucaaauuaaugccaggcauugaacauuuccugcuuuguguacacauagaaccugauaugcugaccuuuagcauuuagaagaagacuaaugugaaaguuaacagccaccuugugcaguaggugauuagugcgcaugcucagccugaugcugaacgaauguuggauggcaaugcuguuuucuugcauggcuuuaguugcacagcugugcaauuuuuccagauuauuuucaauauuaagagaucucuaagcacuccauuuccuuguauuaaacuucuaacuuuuaauacugcauuacuuagaaagaugucuuagugacacaaaguuauucuagugacuauccaugugguaauuaauuuuuacaccaucuuuucauagcuggaucucacugugguauuuauugcuuuacauuuauuuaugaaaauguuuugcuggauauuaaauucaagauuggcaguuauuuugccauuuuaaagaugguuuucugccuuccaacauuuucguugucauucaaauuguuucuguuuuagagguaauguaucuuugucuuuucucuuagagguaauguaucucacacaacuuucucuggaugcuuugagauuuuuccuuauauuuuuagugggaaaacuaaaauguaccaacuauaaauuaaaaaaaaaauuauccuuagguuuguagugcuucaucaaucugagaccugauguucuuugucaguuuuagaaaacucuugguuaguaucuguuuaaauguuuaguaucuaauuuaaacaguuguucugccacauuccuuuuucuucuuggagucugguuaaaaaaaaaguugcacuauuucccaugcuguuuucuguuuuucauccuuuuuccucuguaccaaccuauauauuuucuucugaucuuucaguucacuaaucuuccauucugcaguuaaauccacuuuuucaggacuucauuuuauuacauuuuuuucaauuuagaauuuccauuuuuuuaaagauacaguuucuggcaaaauucuuguuaccuauuuucuuaaacauuuuaauuauaauuacuugaaagucuugucugucuucaguaucugcauuauauguaugucuuucugguuuuucaucuuaacuuuuagccauuuaauccugaugccuguagugucuacuuaguuugacuaagugguagacauuguacaugaaaaacuauggaaacuaauguuauugcguccagaaagaauuguucuuacggaugguauaggguuaguacaucuuguaaaggcuguucuauuucugguuugcccuuaucaugaaggcacagcccuucaggggucucaauggaaagccugaaauucauucuuuuuucuccuagcacuaucaaacuacuggauuuguaguuaauuuuuuagccuuuuaggaacuauuuucugcuuagcgucucagcuacacagccagcuuaggaacuggcaacugccuugaacggaaaagauguggagaaugucggguuaauuauaguaugaucuuggcuccucaaaucuuagcugcuuugguuguucuccagugcuuucaaacaguuguuuuucuguuuuguauuacuauuuuaaguuuuauccaacuagggugguuagucugauacaggcaacauuuaggauuagaaguuuccaauuccuauuuuccaugauuacuuuuaagacauucucaaagcaugaaaauauagucuuuaucuuuaauaaguguuaagcuuguccucuguguauuuuugcuauggccuccuaacauuagcaugauauaaaaucuuuaaagcaggaaacagaaguaacauuuauugaguuccaaaaacaugcaggcccuuaauaaagauuuuaccaauauuuucaagucuaguuggaaagauagcacauuuccaaaaugauauaaauuauuaccuaauauuguacuuacauaucaaaugauuugaaauaauacuaaaggaagacaagaacauuuguuguacacaacuguucacuuaaacucuagaacaagcauauguaugaagagaugauguuuccauuuuaacaggugaagaaaaaugaucaguuuagaaaaauuugaaaauacagaaucaccuacaaucuccuuagagauaauuacuuagaacauuuuuggucuaagaacauuucuagucuuuuuccagugcauauaaagcuuuucaaauuagcugugugcaguucuagcaguucagcuucaaucuguuuguaacuuuauuucuaauguauuuuacaauuaauugaaauuucuuuaguuuacacuuugaaauacugauaacauuuuaauagugcugacauaaaguuuucuaaaauauauauagcugacuuuuuuuuaguaaugaucugguacaauggaguauuauuucuuuaagaauuauaauuuuauguuaauuauuuauugugaguguuuuggaagcugguauaaauauuuugcuacuuuuuauuaagcuuccuaauaauuuuuguuuuuauuuuaaaggccaaacuguuuucagauaguaguucagcacuuuagugaagaacauuacaucuuuuacuuugcaggagaaacuccagaacaagcagagguaagauuacuguuucucaaacuacaguauacuuuuauguuagcccauguuuucuuauuaacuggaauagaaaaugaucgcauucaagauaaagugacagaacgccugaaaucuaaucaucucuuauuuuaaggaaugagauuucauauguaaaaaguuuucugaaagaaaugcaaaaacaaacacagugaaggguuauuaggaaugaaaacuccauuuuaaauugaccuuuaaauacucuaugauguugaggccaacugagaaugcucauuuaaaauccucucugcauaaagguuauaggucaucucaguauaauccaaagguaagccaguuaaccaguuaguuuugcuaacaagcauuauucuucacugguugaacuccaugucugaaaauaaaagucagucaacacaaggaaagauauuuuaggaaucuauucucuaagccaagucgagauauaaugucuacuuuagauuagcuauuaauccaugugcaguguccuucuuauagcgucuauuaaguaauugugugaagaaauaauauuuuuuaaaaaacacucuuuaaaaaauauuuugcaacaaagggagaacccaccucuauaacaaaaguaaaaaauuagcuagguguucuggcuuaugccuguagucccagccacuggguagaaugaggcaggaagauugcauuagcacaggaguuugaguuacagugaguaagaucgagacacuguaagccagccuaggcaacaaacugagacacugucucuuaaaaaauuuuuuugcuuucuuugaacccuaauauuucuggaguauaugguuguauuuuauacaaauacagcuaaauuucugcuuauauucuaacgaaggaacuuaaaggugguuaagaagugaaaguggcuuuguuggaaauauaauuugccaacccuagauaugaggaagaugcucuuaaaacuagauccuagcgugagacucacagaauaaaccugaaugagcuuacaacugaacgucauauuucacaucuuuaucaaauaucucauuuaaugcucauuucacauguaaugcacauaaaauuuuacggcuauguaucccuaauuuuuagaugagaaagguagugcucaaaacauuuugguaacuuacaugauuuuuuuaaauguuagaaauugaguuagaaauuuaaacuucaguauccuauuuucuaaguauuuuaccauggucccucuuucugaauaaaaugucacauaccauaaugacauuucagcauguuuugcaagccuaacauagaacauuuuuuaauguauuuauacauaauauuucuguauuuccauaaaugguauuuccaguuuuuguugauuuauugggcugugggggucucugguuauucucuucuauuucaaaaagcuaugguaacugauuugguuuuaauuugcuguaauauaaagacagucucuagauauuaauaaaguucagcuucauugaaauagccaacaaacuaaagacauaauugaauaaagcaauaguacacagcuuuccagaaauauguaaaaaccaaagugaauauuuagauuuguuuuuaauaaaccuuaguucucuccuuuuccccaaagcacuagauaaacauuuuaaaaauauggcugcaauuugauuugaauauuaggcuaaaaugauuuuuaaaaucuaauguuauauuugagaagcuuaaaaauaacccaaauccccuuauacauuucuaccuguaucauggucuaaaguauagauuaauaugcuugucaugggaucggucaucacauuaucaguugguuuuacaaucagcacucucccccucucacaaaguguaucaaguuaaauuccaccuaagcuugccucaaguauaacagcuuaauuauacaguuaauuuccccaagguaguaucuguuugggagaaauaguuucuuuaauguaaauuugauuuuuuggcuaauuaauggccacucgauguguuucauacauaaauucaaacaaagauuuauacagaauuacaauuguuuugguuguuuuauuauuguuauuguuauguuauuguuauuuuauuauugguuauuguuaugaaguacaguauagucugagaauagaaauggcagucuagagaaggaaaaaauuguugaauuugaaaaaaaaaaccuaacugaugauuuggaagccaaauaaacuaguguauauuucuuugaagugcuguuuuucuuugcaggauuggaugaaaggucugcaggcauuuugcaauuuacggaaaaguaguccagggacauccaauaaacgccuucgucaggugaagcuuaauuuucuuggauuuuuaauugucacauuuugcucuaacacuuugcucuuuuuauuuuauuuuuaucugaacuguuuuggacaucauaugggguuaagccaugcugccacuugcuucaguagcaggaaaacguuacuucuuuaugaaagagaauguucuuucuuaguccaugccaacuguuaaaaacauaagaaagauuauucuuccacuuuaaauaacaacacuaaaccaacacagcagaaacgguucuguugggcacuuaauuuuccuucaaaaacuuauuuuggccucuuucaaaaaaguagaacauugaaaagaucaucagauuuauagcacuaaucccaauaaacuuuuuugggauuuucauuuugaagaacagcuuuuaaaaccuacugcuuaacucuuaggaaauauuuaaucuuauuugaaacuguaacaugcccuauacuuugagauuuguggagaguuaagcuaggcuuucucuuuuuuuugccuuuacaaggguaacuuuauaaccuccauuucuuggcuuuuuucuuuuuaguaaucccuguauaauuggaagaaguuaggcaaauuuugacauucucaagguuuaaagaaaguuuaguacaauauuuauuuacuaaccaaagugucuccuguucucuuugugcgaauaucugauaagcugagugauuaacauacuguucuacugggaguggauaaugguugauauuuaggugacuaaauagucccuguaacccaaagucuggcucuuccccagggaaauuuaaguauacacacaaucgccaugucuucauaacauuguaacauuuuguaagcuaucaaaaaucagauuggauuuuugcuaauaagagcaaguuguauuuugugugaaacuugagccauuaaaaugacauuugcagguuuaauauaaucauagcuaacaucucucaagcacuuuuuauguaucagugggcagugugauuuagugauuuacauauacugucagcccuuucuauucauggguucugcaucaguggacucuaccaaccaugggucgaaaaaauacaauaaaaagauacaguauaacaacuauguacauagcauucacauuguauuagguauuacaaguaaucuagagaugauuuacggcauacaggggggcaugcauagauuuuaugcagauacuaugucauuuucuauacgggacuugagcaucuugggcuucguuagcugccaggacagagagguggagggucuuggaaucagucccccacagauacugagggauaacuaguuuguaauacuuauuacaaccuguaguguagacuuuauacuuacauauuagaaagaugaggcuuagagggacggauuugugcaaggccacacaaguaguauauggcaagagagaaagagaaccugauacuagaagguggauggucuaaguuuuggcauccaaacuaacaaauaacuuaguuucuuuagguuuguauccuuuccuguaaaauaagaagguaaagucaguguuuuaaaaauuuuuagcuguggaacucuuuuauagaaauagaaucuuccagauaaguauuauauaacauacgggauuuuaauuugaguagugacaguuguuuacuuauauuaauaaagaauuuucuucuuaacuucauuuucucuuuaucauuguuuuaugguagaaaagguguauuucauuauuucuccaggaauauacugggagaaauaacuuguaaaauaaaauugcauuguuuuuaucuuuuaggugggaagaauuauuuuaaaugucugaauguuuuaaguaugucauauacaaauauauaaccaaagcucacauuuucugaaaaaaaaggggaaaauaagucauuauuuuuggcuuuguaucuuagaguaauugcuuuugaaauguagugcaauucuagaaaucugggguaauauauauauauauauuuuuuuuuuuuuaggucagcagccuuguuuuacauauugaagaagcccauaaacucccaguaaaacauuuuacuaauccauauuguaacaucuaccugaauaguguccaaguagcaaaaacucaugcaagggaagggcaaaacccaguauggucagaagaguuugucuuugaguaagucuuauuuuaucauuacauuaaucauuuucuuuuaccauauugcauuucuuucuguuuuuuuggucucuguaucuaaaccaucagaacaagguaccauauccagguguucuaauagcauauauauauauauauauuuuuuuuuuuuuuuucuguuguuuguucaccuuuauuugugaagugcuaugcccuugguuuuuccacuuaguuauuaacaugaauuagcaagucaaaaaacauuuacuaacccacaaauacaaaacauuuacuaggguuuccaguacuuauuugaaugaauuauuaguuuaggagguuaaagaugguaggaaaaguguguaaucugcgugucuucuguauaccaaauaauaaaauauguugugaaucugguuuuaggucuagcacacuguuuuuuuuuuuaaagcagaaauaggggguuuauuugauacuagaacuaaagaaauaagguaguuugaugccaaaacauuuuguuaauucuuuuucuccuugcuccuuuagugaucuuccuccugacaucaauagauuugaaauaacucuuaguaauaaaacaaagaaaagcaaagauccugauaucuguaaguugauacagaaacuuucuaaaauagaaaaagcauguuuuauauacuuucaaaauucacaaugaaagucuuaaaauagaaauuaaaaaaacagaaaugcaaguaguauaauuugagauaguuucuuucuguacuucuuaaaguauugauuaucaagaaagaauauaccuaagauagaaaaagaccaauaugguucaacuguacacacuguuaagcaauuaagauuaaaauauuuagccacccuccuuucuccaaugaauaggaagaauaaggaaaugauuacaguggucuuuuuguagggcuugcccucaucccuucuuucuacuuuuuagguuuuuccugcuuuuuuuuuucuuuugagauggagucuugcucuuguugcucaggcugcagugcaguggugugaucucggcucacugcaaccuccgccucccagguucaagcaauucuccugccucagccuccugaguaucugggacuacaggcgcccgccaccauaccuggcuaaguuuuguauuuuuaguagagacgggguuucagcauguuggccaggcugguuucaaacuccugaccucaggugaucugccggccucggccucccaaaaugcugggauuacauuaccauauaaguaaaaaaguauucuauuuaaaaauuucccuuaaacuugaaugucauuuauucuauuuaaaaauuucccuuaaacuugaauaugucacuuauucacuucugguagucaaaggcucccaguuccuguccucagcagcacagcuccuuccauccugcugcuaaaacaguugacagugagauuuaccaguucacaucagggugaauuagguuaauaccuucuuaaaacucaggcuuagggaaggaagugauauguauuaacagaucaaagccugaauauuucucuauaaaauguuuauucuguaguuuuuuguaguaauuuuaguuuuccauuacuuuuacgauaaaauccaaaccccauaguaaugacacagaacgaaggccauaccuuauauuugaagugcucuuuuuucuuuuuucacuacuuuucuucuuagcuacaccucuagaucucguccgcucaaggguuaccuguuuaaaguggaguuuucaccuccacaggcugaauuagauauuauuucucuguacucgaauagcauucaccacuguuaacagcacuuaccagugcugaaacauaauugauuucuugccuucuugacuaaacugaccucuaugcaacucaaagaacacaucucaaucaucucuguacucucuaccuaucagaguuuagugcaccguagacacucaguaaauaaacaacuaaauauugaauuugugauguuacugaaaacuccuuuaaugaaaagcauuuaacaccauagggaagacugaacaccaggaaaauuuacuugcaugacuaauuaucguguucucuuuuuaaacaauaauugcuuguuuuucuucccaaguauuuaugcgcugccaguugagccgauuacagaaagggcaugccacagaugaaugguuucugcucagcucccauauaccauuaaaagguauugaaccagggucccugcguguucgagcacgauacucuauggaaaaaaucaugccagaagaagaguacagugaauuuaaagagguauuaaauuauuuaucagucuuguuuuuguuggaauuaacagaaacauuuaacauuuaauaaaagauccauuaagguaaacauaguaauucauagcuuaguagcacaaugaugccagagauuuuaaaccuuguuuuauacuguaauuuugguagaaauaaguagacuacgaauucauucuauuuuaaauaaauuuauucaaugggacaucauuuuaaauauaagaacuugugaaagaacauauuucuuguuagucucauggagcaugcuuauaaugcuacguacuuuaaacaaucuuuuaaaaugucauuuuagcuuauacugcaaaaggaacuucauguagucuaugcuuuaucacauguauguggacaagaccgaacacuacuggccagcauccuacugaggauuuuucuucacgaaaagcuugaaucguuguuguuaugcacacuaaaugacagagaaauaagcauggaagguaugguauggccauguuagugugauacaagaaacuggguuuagauuuuauaucaaggauauauggacucuaucucugaauauacuaaauuguuaaauuauauugcaaaauaaguuauucuguuuucccuccuuaaaaauugcaguuggaugucaguucugauuauguugguuacuaugggaagcugauauuucuaauguagguuuuggcagauaaguacuagaagccacaagaaggugguaucugugucuacaucaauggcuugacuguuuggcauauuuaucuguauucucuuguuuuuuauuuucuuuugagauggcaucucagucgcccaggcugcagugcaguggcgcagucucggcucacugcaaccucuaccucucagguucaagcgauucuccugccucagccuccuaaguagcugggacuacaggcauaugccaccacacccagcuaauuuuuuauuuuauuuuuuuaguagagacggguuuucaccauguuggccaggcuggucuugaacuccugacuucaggugauccgccugccucaagccucccaaagugccgggguuacaggucuuguuuaauuuuuacuucuucauuacacagaagcugggugucagcugcauuuuauuucuaacuuuuauagauagguaguucccaagcugcuggacacagugcuuuuaauggcuuacaaaauaauccacccucccccuggcccacacacaccaccaagcacuuugauucauuaacaguucuugcuucuagguuccccaaauaaauaguaaaguuuagaacuauuuuccuccucaucacaaaauauagauuugucaaggaauagauaaaauggugguccuuauuuuacacuugaguuuaucuuuucugacagcauuuguauuucauuaaaauuuuacugaaacucaguagacauauuuuaagcuaauaaauuaaucuauacugggauuuuguguuauauccuuaauuguaaauaaacccuaaaauuucaaagcauggggucaaugggcagcaaagcugauuuaugguccuaauuuuaucauuagcugucuaauugaucuuaagucauauaacaauucugagucuucauuuuuccauaugaacauggcaguguuaaucccuucuguucaugaucuaaugagguaauacauaugaaagucuuacagaguuaagucuguagaaguauaggaugucauuguaauuaguacuuucaacgcugcacgcaaaaagcacauuuaaguggcuauuccuguugagguaaaaugaauucacuuaauuuccaauuuggucacauuaggucaguccuuuacaaauaaucuucuaauguaaauauuuguguagaugaagccacuacccuauuucgagccacaacacuugcaagcaccuugauggagcaguauaugaaagccacugcuacacaguuuguucaucaugcuuugaaagacucuauuuuaaagauaauggaaagcaagcagucuugugagguaagaauuuaauguuuuaauaaguauuuuugcaaagaacauauuuuaauagguaauaauuuguagccaauuacauuuuaaggaaaauauauuaaauuucuaaaauuauuccucauagcaguuacaccugucuguaauacauuuauaaaaauguucugcaaaauggacuucuuaaaaaagauguacuuuauuuugggauuaaaaaccaucaaguugcaccagaaauucaugaaaauacuuugucauuuccucuacuguacuaauaaucuauauacuacuuacagaaagcgugcauaagauaaauugaagguuuuguuagugacucauuauauaaccuauguagcacuucauuacaucuugguuuguucuugaagguuuuuuugcgaggggagaauuaugagauaaccucaacuaaaacaaaaaaaucuuuuuaggauuauuaaaguuucaguauaaauucauaauacacuauuaagacaguaaguggaaucucacacacauauucucucauuuuaaugguaaagcaacuacaaagaaauaauauauauuagaucugauauaaaaaucaguuuaaggaauuguuuuugacaauggacacugggaccuagcaaauguuaauccugcacgaaggugucgauucauacuaauaacuugaagggaagaaauuagugauuuaauguuggaaaugugggguaaugccauaguuggccuaacauaaggaugacacagaagugcagcagguagguagggagucucuggacuuuagagauaggcuacggaauuccgacuuccauagauaaauguacucugcugacacuagaucagaaggguuacaggaaaaguucugagaaagguuugugauucugccuaaggcauuugauauuuuuauuagccauuaaauaagccucauucagaaaagcuuuuaaucagcuuuuuuuccccucaaauaaauagaauugacuaagcacuguuugcuuuucaguuggcuaauugggaauaaaugguaacagaccuaccaggaggaguuccauagagaaaacuacuuaaaaacucccauuauacaaagaaaaaagaucaauacacacagagauaccgaaaaauagacaaccucgaaaacuauaacuacuuguuuuccucuauucauuugcauuugucauugccaacaugcauuuauauugauuuauuccuucuuuuaguuaaguccaucaaaguuagaaaaaaaugaagaugugaacacuaauuuaacacaccuauugaacauacuuucagagcuuguggagaaaauauucauggcuucagaaauacuuccaccguaaguggugaaauuuucauuugacaagaaauuguguaucuaugucuucagaaauuucuauuucuaaaacgugaaagcuuuucuguuguccuaauauuauuauacucugaaaaagucaugguuaaucuuuaugagaugaauuguauuuaaagaaaauagcugucuuaauaaaaccacccauuauuuucguacaagccaauaugucugguuuguacuguaguagcuuggggagugaauagagguuuauaguuucagauuugagauuguaaaagauaucuugucuauccauuuagucuauacuugauagacuaaucacucuguuaauaugcuugucggccuccaguauuagugaacucacuuguucagguagaaguuaacuuaagucuaaaucuugcuccccagaauuugcagcugguugguucucuauaucugaaaguaaaugucaggaaguugacugaauaaauugaugauaaacuuaguggauaaaguuuuccuuaccccuugcuaaaugccucauuaccuguggcaaaauacuuuuuuggguaaaaggccaguuuuauugaacugugguauauuuggguaaauuaagcuuuuggcugcuaggagaucaguguuuucacuugcuuucuguguugagaugauuguguuauuuuggcaggacauugagauauauuuauggguguuuacagaaaucuguucagcauaaguggccuacaaauaccaccaugagaacaagaguuguuagguaaggcucaucaauugauuuguuaaaucacauacuaauagguggauaauugugaaaaauugaggaauaacaauauacaauucaaugcuuuuuucuuuggcuuuuaugucaaagcccuguugcauauuuucuaaguccagauggcuccuaaacugaaaguuacugugagauuuagcugccguuugcauuuucuaaaaacaugaacauucauuuauagucaaguauuggggauuuuuaaacccuuacaagaugaggcuaaaaguuauauaacaaaaucuguagcuaacuucauauaguauucuucauacauacacacacauugauuggcagugagagagaagggcaguaauugaccgauuuagauauuaauugguuuguuacaaucugugacucugagcuaaucagaaccagaacauguaguucugaagcuguguuucagucugcucauuguaccauaauuaggaagaacugcuuuggcaaaucauggaauuugggagcuuauauaaagggacuucauuaucauuauucuauaggaagaacugcuuuggcaaaucauggaauuugggagcuuacguaagguuacuucauuaucauuauucuaacuuauuuuuccaaugaagaagcagaucugucuggagagguuaaguugaacuaagguuuuauagaaagcugguggcuaaggcagaacuaaagguaacuuucuaagacccaaucugauauccuugagucuuauuguaggcuuuugcuuuuguuaagcauacuccaacuaauaccccaacuaauuccaggcaaauggaaguuuaaugcgaaagcgucauggaauacagcaguuuucuaauaauauaauuuguuauuuagaauauacacugucaugucaugcuauauguaaaauaauuaggcaaccauuaacaccauuauuacacaguuuguuuugaaaauguguuaauccugccuccaaccuaaauuuugucaaggggcuucuauuucuuuuuuuggggggcagguaauauuucucuugguuaugauaugacauaauauuuaagaacuacagauucuguuuuucuuggcauuaguggugauugggaggaauagaaaagaauuacaagcauaauauuccagcacaguuacgugugagauguaaauuaaaacuguucuauaaauuuguaaguuucaaacaaguauaacuguuaagcaaacacagcaggaaauuguaaacuguuucgugcaagaggguguuuuagggcauuuuugccaagguuagguuucaggcucauagaccuacuauguauaauuaucacaauauuuucaaguaaaguuuacaagauucuuuaaauuugggaaguccaaaauuaaagacuuaauuguuauuuuuuugagacagggucuugcucuguugcccaugcuggagugcaguggugugauuucggcuuacugcaacccccgccucccagguucaagugagauucuugugcuucauccacccaaguagcuggauuacaggcaugcaccaccauaccuggcuauuuuuguauuuuuaguagagaugggguuagaccauguuggccaggcuggucuugaacuccuggccucaggugguacacccaccucggccucccaaaguguuggauuacaggcaugagccaccaugcccagccaauauauuagaauuucuauaaaugcuguuugagaaguaacaucuuuacuuucuaagaguccaaaaauuagcaaacagguacauguucaaagguaaaugcuaagaaauuggguaauccacucuaacagagaacagagauuguaucuauuaaucuauagaaggaauugcguaacucauuauuuugggaauaaugcuugucuuuacauggauuaugucuaucaaucuguagaaggaauugcauaauucauuauuuuaggaauaaugcuugucuuuacauggggcaaguaagagguuaauuauuaguguggauucuucuuaaaaggaaauuagaaauuaucuacaugacaacauauccucccuaccagugacuaaaggaggcagaauaggaguaucuaugcaagcuuuuaacacugacauugucccaaaguaaaauuagcagauaaaaucauauaugacagcuguuaguauaauuuuugcuuuugcuauuguuuuauaauuugacaacuuuuuaaaacuuuagaauuccuaaugucuugucuuaaaaguuuuucaggcugggcaugguggcucaagccuguaaucucaacauguuuagaccaagacaggaggauugcuugaggccaggaauuugaaauuguccugggcaccguagcgagacucugcuuucuacaaaaauaauuaaaaaaaaaaaaaaauugccagguauggugaugugcaccuguaguccuaacuacucuaagccugaggcaagagaauuguuugaucccagggguucaagguugcagugagcugugauugugggccacugcacuccagccugggugacagaacaaaacccuaucucaaagaaaacaaagaaaaaaggaaaaaagaaaaccuuuccaguguucuauuauagacauuuucauugaucaauaagucacuuuuucucuagugcaauggauucuuauuuuuaugugaaucaucaacaaaaucaaugcaaccaacuuaggcuguucuguuuaaauaaauuaagaaaugagggugugugaaguucuaaaauuguacagaacuaugcuuauauaaaaaguuuauuucuacuccugugguauuucagaaauucuuaagauuccugaggauacuacuuucucuaaguaucaaaugaccacuagccuggaauaauaaauaguaagcaagacaguaaauacuacagauaaacaacauuuucccaaaguuaauccacauucuaaauugggaaaagugaguaauacauucaagaagcagauauauauauucuuaaaauacgaugcuuuggcuuacuguuuucuuaaagcuuucugugucugggcuuucuuuuauugguuuagagugaauuuuauggguucuaugaguacuaaaaauucuguuuauauauauuguuuuaauguaacacauuauauagguguuuucuaaaaaaaaaaaaaaaaaauuucccucccauucagugguuuuguuuuucuucgacucaucuguccugccauccugaauccacggauguucaauaucaucucagguaaucagcuuuugauacauuuugaaauucaaaauauuagaauuaacaguuucauacuauuuaagaauacucuuaaaucuuuuuuuuuuuuuugaucauccaauucuagucauggcauauaugaaguauuccaaagcacccuuccuuccuugugcuugugcuucuugggcuuuuuucuuuuuguuucuuuucuuccaucucauaucuggucugagauggcaugauuacacacauuccaccuuuuuucuaccccuauuugugucucaaaccuuuauaauaagugacuucuuguagucugcagcuuggcuuuuucaaguugggaagagcuuugcuuagcccauugcuagacugcugccagcuagaucuucaagaucaaauuaaaugauauguacaguuggaauaguauucugugaguacuuaugaagaaagcaguccugguuccucccguuagagauuuuuaaagucaccaguuauauaguguaaauuggccauuuuaaacuucaguaaaccugauccaguuuuauuacccauauauccauuuugagaugacuuucagguguuaaaagcuucuuucaaagaaaggauaacagggauauuugugacuuugaauguaauaaugaaccauuauaaacaguaggaacuggaaccauuuuuaccuuaauaaucugaagcucaaaauuguacuaaaaauguuuuggaaugucuuaauuuuuacuucuauauagccaucacaucucuguaauuaucuuuuauugcuacuaaagugguuaaaucuauaaauuauuaauauuaaggguuugaaauucuuuuggagagauuuaucuggauguucgccucagacaacaccaucuaaaacuaggcagucagguagauuauuuaugggauuuuacuguuaaauaauuaaguuccagagcuuauauuuaauagacaccaauacuuuucauuuacauccuacuaucuguguuccacagggaagugcuuccugacuuaccuuuaaaauauuuuaaaaguuuauuaaauuucauguuuuucuccucaaaauaaagcagagguccuagacuuuaucuugcuucuugagcuuuaagcgaauuauuuggacugcaaauaauguugggagcagggaauugcucagauugcuaaccugaguagguugaaauuagcuuugugaacugucauaaaagaugugaggagugacaaucuuuuuuagugauaaagguaaagcuuugagguccuuugaaauaguaucaaccguuggaaacugcugaguuuuguaguacccuuuucgcaagccuagaagcacugauaagcauauucacuuuuucucuuuuaauucaaguucuuuugaauuuuauggaucauaaauuuuucaaaaaacauuuuuccaaaaacauucugaguuccgaauggaagaauggguaguaguuuaacaguaaagaaauauuaaagugcuaaauuuauaaugguuuagcuggaagugcuguuggacuuggugucauuagcugugcccaauucuguuacagauucuccaucuccuauugcugcaagaacacugauauuaguggcuaaaucugugcagaacuuagcaaaucuuguggaauuuggagcuaagguaaaaacauuuugauacuuuaaaauguaauuuaugaaugcaaguuugacaugauaaaaccauaaauuguggcuuaaguaaauuuuuagcagugaaauuuuuagcgaugaaagauuauuuuuguugguauguuuguuuuuaaaguagcuuguuuaaauuuuacauuuuaauaguggaacuuuaaaaaacacaaauuuagccauuauagaaaacgaauuuuucaagguccaguguacucaaauucucccacuuuuaaacauaaucaaugaguacauuuuaauacaaaaagucauuuaaaaauuuauuucacaaacauucacuguaaauguuaaaacucaagauuuuauuuuuuuaaacaccuacacuuaauuguacuaucuaaggauaaugacugauauucaguugggaucauaucaugccuccugcuuuugucaccuaauacgugacagacuucuugccauauguggaaauagauaacucuuucacuauucuuaauaauggauauuuagauggcuuccauuugucccuguuauuguuguaacauauauucuugcauacauuuccuuucauacuuacucaauuauuagcugaacuuuggaguaaaaucacuaaguaaauacguuuuaggcuuuugcuauguguuacaagauuuccugucagcaauuuaagauacuuuuauugcuccucacagccuugccagaacucauuggguacuauacuuuuuucuuuuuugccaauuggauaggcauaauauuuuguguuucauuauuuuauuacuguuagagagacuuucaugucuuuaucuuuggaauugccuauugagguccuuaucucauugaguuucuuacugauuuuaaaagaguguguuaaucuuaacauuuucccuauuuauagcaugguuuuaaguagucaggauuuuaguacgaugagcaguuaacuacguguauggccuagguuuugaauucaucugaaucuuugaggcagguuacaaauaagauauuuuccuauugcagucuuuauuauauuguauuuuaauucccuguaaucucugcuggauucaaaccuaugauuuggggccauguuugagugaauuuauauauaaacaauuugugucugccaggcuauguguuacgauuugugcuuggguccagaauuuucuuucauuaaaaauacccauacuccucaguauagccauuugcuuauauacuagaaggaaaauacugucauuauaugauuuaauuaauucuugugaauguguugcugcugcuacaccuaauuuauaagaaguauugcuacauguauggguuuugcuauauuaauuuggugcaauaguaauugcaguuuuugcuguuaacuguaauuacuuuugcaccaaccuaauagaucaaacagugguuuguuucuggugcauauaacagaagcauuuuauuuuucaggagcccuacauggaaggugucaauccauucaucaaaagcaacaaacaucguaugaucauguuuuuagaugaacuugggguauguauauaguuuucagguacuuuuuuuaagacuucuaguugauauagcugaguuaacccauuuaagcagcaaucuuuagaaagauuuucuauccaaaacuaaaaagacaaaaagccugcaaauuuuugucugccuuccuaaacaaaaaacauauuuuuguuuguaauuaaaaccauuuauucuuacacuaaauaguuuacaccaaagcauacauuauuguggcuuuuagacuacuuccaucauuuuuuagggucugucuugcuuuucauauccuuuuaaagcuaucacaucugacugccaugacauucuguugccuccuuagcuuuuuuacuuugcugcuacuauguggggcgugaagcaagacgaugacacaguucugaccagguuaaauaaguagacugaaaagucuucuuuucuaggaauaaaagacguggauucgguguuacacuucauucagugugaauaucugugccucauuugggccuuguuaauaaaauaaauugugauuacaaaauuacgaaugaggguauuuuauaauuucuaggacccugccuuucuuaaucaaguuaaauuuucaugauugaacagauuuucagguacugagucaguuuuaaacuaaacuuauuaguaauucaguucauauacagagaaaccaggaaggugcauguacaugugaauagagccagguguaaggcauggcauuagggagugcuaggauuggagauugagguguccauguucugucuuaauguauucagauucaguuaaaaagaccaccacaauuuguggcaaacaaaucaggaaugccguugagucacuaguuugcaaccucagguauaaaaacuaguguaugaaaaauuauggcauagcuccauauuuauagugaaauuuauagugaaauggacaaaaaugcuaaaaguccaucaugcuucuauaugugaacugggauauaguuggucaaucauuggaaaauauuuuuacuauaauguuuaaggaacugugugagaaguuaugccacacaaucuaagauuucauacugcuuagaauccaaauauaauacuaccauauuucuucaccaccuguauaauaagccaaauuuauuuuugaagacccaccucaauuauuaucuccuucaggaagcuuuugcugaaccccaaacaugaauaaaauaacuuuuguuuuaccuccuaagcauccccuguguaucugugauauauaauucuguguugcuaugauuacuuuauucuaaaguccuuucuacuggagucaguucucugaaggcaaauauggagucuuucaucgcuauaaaccuuuaaucacugaauguauucugaguaacuguguuucucugucccauagauaacauuguuuugcaguuuuuagcaauguaaagcaaauacugucaccauuuuacugguaauccaagcccuuguuaaauguuauuccaaggcuuaaaauaacacuggcauuuagugucgauaauaaaguacagguugaguaucccuaaucugaaaucugaaaugcuaaaaaauccaaaacuuguugagcaccaacaggaaaugcuauuuggaaaaucuccaauuuuggauuuuuggauuggggaugcucaacuggcaaguauacugcaaauauuccaaaauccgaaacacuucuggucucaagcauuuugggugauauucaaccuauacuauaaacuuucauuauagugacuaaguuacuuuaugaaccuuaucugaaaguaccauaauuaacacugauuauucccacacauuagcaaguauucugagcauaguccacagauaauugcaaaccugacagguucucauugcauuuucauagugcaguuccuacuuauaugcauuaucaacuuagacaaacuacaggagcuuaauaaugaaauuucaucuaggaauuuuaaguuuaggcugcauuuaauccagauuagcaguuaaccuacacuauuuggcauauguucuagauuuuuucagauacaaagcuaauuguuaggaagccacaccccccaccccuuauuuuuagaauagcaauaauauuguacacaucugucaugcuacggaaaaaaauggaaucuggcuuucaugugaauacaaagguuacaaagucuauauuuuaccaucauuaauacugaauauuauauuucaauaagaaucuuuagaauuuuaagagaaauuugaguauuaaaaaaauuaucuaauauacccaauuagaaucuuuucacaugagacuacagagaaagauuuguauuuguaacaaaaaauuagcugggcaugguggcaggugccuguaaucccagcuacuugggaggcugaggcaggagaaucgcuugaacccgggaggcggagguugcagugagccgagaucaugccauugcauuucagccugggcaacaagagcgaaacucugucucaaaaaaaacaaaaaaaaagaagauuuguauuucuaaaugcaauuuuacgauucccuuaaagaauguaccugaacuuccggacacuacagagcauucuagaacggaccugucccgugauuuagcagcauugcaugagauuugcguggcucauucagaugaacuucgaacgcucaguaaugagcguggugcacagcagguaggcuuucgccagccuucauuaacaaugauguuucaaagauaacacuuagagaguuaauaaauagcugaauucugguuaacauuuuuaucuuguuacauuaaauuuuugagacucugcaucauauuacaaaagaucucagcagacagaaauaacgggccccgacuaaaaugauguacauuuaauacugaaaaacaucagguuuugcucuugagucugaauguuaauucuacuggaaaacaguguaauaacacuuugguagcaugugugaaaauggcuaguuaguaagucaauauugauuuuauuuuuuuuucuuucaguuucugucuugucuuuucucugucacauacagauauagugcauggccaaagugauucucaaacugugaaacaaaugauuauuauuugggauguuugucaaauuucacauccagagguucugaaguguggccuugaaagcugcacgucuaacaaacucuuagaggaauuuauagguauuccgaugcaagugaaccauggccuacacuuugagaaacaguagacuacauugauagacuucuaucugccaucugcaccaaacagauacagauaaggauguauucaaagaccagaccagaauuugaagggacuuaauaccaggucaauuaagauauuggagauauagaacaaaaugaguuacacuuugaauguccucagcugacauaagggcuacugagaggaagugaccacagggacaguuuugacuaguuucuaauguaguuucaggagauagugaaugcugucaccgcacuggcuaaccauuuggcagggauuuuguagaagggauuaaagcauugaguuuggugacugaguucucuacaaccugagauucuagaauccucaaguccuguuucuccccgccccuccccccgcagcuuucaaaacuaauaauaugacuugacuugccuuagauauuaaauaaaaaaagccuuuuuuaaaagagagauaaacugcuucugacaacaugugauagugugauaguucuggccuaaaaaauaggagcaugccaaacacaaacaaauuucuguucacuuuaggguauaaaaauucucuuaguuaugaccagaaauacucagccaaugacugaauaauagagacuuauguuuugaggggaauugugguaauauuuuaugcauccuuuugcuuugauacaguuuuuuucaaauccagguucccauccugaaauugcugaccgagcuuucauuuauuuucauaccauuuuuccucugucuagcacguauugaaaaagcuucuggcuauaacagaacugcuucaacaaaaacaaaaccaguauacaaaaaccaaugaugucagguagcagccuucgccccaguguucugcauggauucagcauguccaacaugguaauucacuucaguuuaaugucuccuuugcucuugccaaaaaauagcacacuuuuccacauuccagugaugugugagcuaugcaaacaaaauccaagauucugcuggugaauaacuaugccagcaaccuuguaagcuaucugugcaggauauuugcacuauuuccacauggaaucaaucuuuaacaaccucugagccuugguguacagaccaccuuucacaaaacgaaaugcuaugacuguaucuugauaucucgaacuuucaaaauauauuuucaguacacccaguugccaaaguuuugcugucucuuagagaaagaacuaugaaaucaacugacaagaaacacauucuuauugacaauuguguauaacuggauugcagacuguucuuacuguaacuacuuccugauuaggaauaugaccauuugacuguucaaugauuauuuguauuuacaguuuccagaguuugucauuauaauaggaacaaucuuugcuguauacuuuuaaaaaauacucugcuauuucucuugcuggaacuguugaaagaaaauauauagaaugaucuauugcucaucagcuuuauuuuuuaaacauacgacuuauuuuguugaaauugucaaagacuguauuuagaucucauaaugcuuuguuaaauguuuacaaguaaauaguuugaauucaguaaauauuauugguuguuguauugaucaaugcauguuacccauucaaccauuuuauagacuaccaauuucuuuuauguuaacuagaaugcuuuuguuaaaaguuauuuguucauuauuugugcuaccccuuugauuaugcagacaaccucaucagcugccuaacuuauccaucuuugaacuucugacuacuuguuguaucugcuggauauuuaguucaacuguauaguuuuauuuacuucuguauguguauuuuugugaaguauucacaaagguuaaguuaaaauaaaaccaagggauaucuugcauaauugauua

SEQ ID NO: 193037 - RNA, 140499 nt, Homo sapiens
gcggccgcggccggaggagcaauagcagcagccguggcggccacggggcggggcgcggcggucggugaccgcggccggggcugcaggcggcggagcggcuggguaaggccgggcccagggcggguggggccgcucccccuuggucagcugccgggccuuugugugggcccgggcgggcgggagccgcggcggaagccccgccccggccguggggacgcgcgggucgggccgggcgcgcgggguugggcggggcgcggcggcuggccuccggaugggcccaguagccuugucgcaccugccggcagggacaaaggcgcacuacgggucggaaacuccccgcgcuccucuuucccgcucgucgcggggcagcuucaaagcugucaacguuucccucaguccccaauaccagugacaggucgggaaaguccuucauuuccuccguugcucagggccucuuuuuuuuguugugguuucuugacgguucgacacaaacucuuagugauuuucuuuccguauuuuuuccggguauuuuaaucaaugggacuuguauuuauaguagaggccagauauuucagcuucucaacaccacaaagaauccgggauuuugggaacuguguauauuucuugguuuggggaagcacaguuuuguuauuauaauaaguuuuaauuuaaaggggaagaaagaguugcaaaaauauagaaaaagcccugaaaaauaaguacacgguauaguggauauagaaauucuuacaauaauuauagaagcguauguuggggugaauuguuuuaauuaacuuacuuuccaacacaggauucuugacaaauaauuuuagguauuauuuuuuucuccauuuggcuaugugcuuuuccccaaaaagugcaaauuggacucaugcacauaaaagaguagcauaauuuuugcuuuauuacuuacaggucgcccauauuugauuuugagcuccaaaauggaagauuggaaaauauguuuugaagagguguuucaaauuaaaacaauaaagaguuuauguguggaugaauggaagggccuugaccgcuuucuuuggcuuugggaauguacaaaauaccucaaauguuaauauccuaccaaaauucccaagauaaguaaauugugguguaucuauaugauagauuacuaucaagucaucaaacaucaugaggaagaauguugacuuggaagaaccuucacuaaaacacaggcuguagaauaauauaugugguuuguuaacauuuugguaaaaaauaauagguaacuaaggcauaaauaccaaaaaccgaaugacaacguuaagagugguuuuuuucuuggaaguagguuuauagguguuuuuuuuccuuugaguccuguuuuccaagauuuuguuuuaaacauguauuguauugcuaaauauuacuagaaauauaggagagggcuaaaguucauaaacggucgaaauacacuguuugucuauaguaagucgauauucucccaguugcacauuauuaaguauucuuaacuguccacuauaaauuauugauuguuagacuuuugaacuuguaacuguaaucaaggccauuuuaaaacuuggcauugaacucuggaaucugucuuuccucuucauggaaagacaaaauugcugaagggaugcuuacaggcauuuuuuuuuuuuuuuuuuuuuuuuuuuugagacaaggucugacuuuguugcccaggcuggaguucaguaaagugaucauggcucacugaagccuugugcuccuaggcucaagcaguccucucaccucagcaucccaaguagcugggauuacugaugugcagcaccacacccagcuaauuuuaauuuuuguagagaaaagaucaaucuauguuauccagucuggucuugaacucucugccucaagcggucauccugccucagccucuccaagugcugggacuacagauaugagccccugugccuggcugaggacuuuuaaacuauacaaauaaacuuuuuuuuuugaaggucucaagugcacuuuuuuuuuguuuuuuuuggagacagucuuacucugucccccagccuggagugcaguggcgcaaucccagcucacugcaaucucugccucucugguucaagcaauucucgugccucacccucucgagugccugggauuacaggugcaugccaccaccuugccuagauaauuuuuuguauuuuugauagagacgggguuucaccguguuggccaggcuggucuugaacuccugaccucaggugaucugcccaccucagccuccuaaauugcugggauuacaggcaugagccacugugccuggcccuaagugcacuuuuaauacauuuauuaaaagauaaacugagcacauaaccuauaccaaauacuauccuguaagacaggucuacaaaaaugaauaugcuguuccugugccuggggaacaugcagaagugauuucacuuuauguuguuuuuuuuuuuuucuugagacggucucgcucugucacccagacuggagugcagugguaugaucucggcuugcugcaaccucugccuccuggguucaagcaauucucaugcuucagccucccaaguaacuggguuuacaggcaugcacugccucagccagcuaauuuuuuuuuuuauuauuuuuuugagacagagucuugcucugacguccaggguggagugcaguggugccaucucggcucacugcaaccuccgccucccggguucaagcgauucuccugccucagucucccaaguagcugggauuacaggugcgugccaccaagcccagccaauuuuuuuuguauuuuuaguggagacgggguuucaccguguuagccaggauggucuugaucuccugaccucaggugauccauccgccuuagccucccaaagcgcugggauuacagacaugagccaccgcacccagcuaaauuuuuguauuuuucuuuaguagagacaggguuucaccacguuggccagucuggucucgaacuccaagugaugcacuggccucggccuuccaaagugcugggauuacaggcaugacccaccacucccggcauuacguucuuauuuuagagaugaaacagaucugagagguuacaucaacuaaucagacaacaucaagcugauaaucagagguggaagacuuaggacuccuauucuggucuuaggagcaaagguccuguuguuucucccaccuuauaacauugcccuucuugucagacuuucaaaauacauuuuaaaaugugucccauggauaagaaaauacuugaaaauuauccuuaaguugaaacuuuuucuuaucuuaccaaaguaaauuaaugauucaaggauauugggauauugugucauccgaacgacauacacaugcugauaauguauuuuuuugucauuugauuuucaguggauuauuuauaaaaguaauuuugaacuccugccaaaaugguuggcccuuuuuuuuuuuuuuuuaaccuugucaaauuuuuauauggugucuccaaugcagauaggacuuuuggaaauaaauguucuuucucugaauuuuuuuuuugugggggaggguguuuuccagaccuuuugcucacaugagccauucuugguuuguuccagcuugccaacacuuggugucacaugugagccucccacauguauucacucuccauuccagcucugugauugaacucugcucuuauugacuagggggcaguugggcaggcaugccucauuccuggaauugacagucauuccuaaugugaguaaaggggaaccucaaugagacaucuuuaaacauaugaaagcauuugguuuuaaaauggaagaacugucagguacuguuagugccugagccuuugcagcaguuuguuugauagguacaagagaacugauaugccuguuuucuccaguucucuuuaucuuucuuuagcaguucuauuugaauguuuucuaucuauucguacucauuuuuacuccuucugacccuucuuuucuauuucccccuucucugccuuguucuucuuuuucaguuuugaauauacuaacacugaaucagcacuucuaaagcccuuccuucucccacuggcuucacuuggcuuucagacauaaugaggagacuggcuuuucgaggcgcugguugugcucugguaaagcugguaaauuacugauuaucuacacccuuucccuuuucuguccuuccuugacuuuuuccuuccaccuuucuuaaauuuuuguuauccuuuccacaaagauucccuccuuauguucaucaaauucacuugugucuuugucauagauuguuuaaaagggauugguccuuaauuuaucuuaaugaauugaguccuguugaucagcuuuuuauaaaaugaacaaaaaucagcaaaacuuggcuaaguuuuggcuaagccuuuugacgauuuuaacuacuuuuagccaacuucaaacuaauaauacuguauaacaaaccgaagccuagaguaaggaacaucaucgugguagauuuuguuuuaaacaccauguggacuuuaguuuggaaaaagagaucugagacuucucuuuuuccuuaauugcucaccaggauuuucaaaugugauucuuuugcuccuucuuucuguuuccuggagauccccaaccuuucuuuccauacugcuggcaaccaguguucuccuguucuaaucauucagcugcuggugucguaguguccugaaauucaguguuuccaugugccuuacaauuaugagguacucuaguucuaugagguuccucauaauuguaaggcacauggaaaagcagaugaggugcugacucaagaagugaauaccuuggggccucugaaccccaggccugccugacuaccucaggggcugaaggaucaauaccuucaguguugaugagugaaacugggaucuuuuuuuuucuuuuagcuuuagaaaaaggccuuugacgggcggaucacgaggucaagagauugggaccauccuagccaacauggugaaaccccgucucuacuaaaaauacaaaaauuagcugggugugauggcacacgccuuagucccagauacucuggaggcugaggcaggagaaucgcuugaaacugggagguggagggagguugcagugagcagagaucgugccacuguacuccagccuggugacagagcgagacuccaccuaaaaaagaaagaaagaaagaaagaaaaaggccuuucaaaucacaauauacuauuugauaguauuguuagauuguauugcaauauaagcauugcaggacuuucuuggguauauacuaucuguagcagaucauucagugguugcauuucuuguguuguaaauagaguuauaguuaaaauuguuauaguuaaauagaguacguguuauaguuagaguaugucauaucacuaaaaggugauuaguuugaauuaacagaagaguuucaaaggauaguuuguaccucugucuagguauagcaagucucauuaaguguuuuccagggauaugucuuguggauccuguuuuaaugaauggagaacauucauuuucaggguuuuaauuuuagaguacaucuaaagugcuagaagguuaauuguccucuguccccuuaccuuuuugcacuacucauuuguccugggcucugcuucuugcucuuuuccacaugauggcccaccuagcaaaugaucauaauuguaaggcacauagagaagcagaugaggugcugacuccagagguggauaccuuggggccucuguaccccaggccugccugacugccucaugggcugaaggcuuaauaccuucagcacacuaauguacugcuacauauagguugggaaacucuaggccaaauuuggagccagaaguugagucauucaagauugcugauauacaaaugaauaugcuuuuguugaauuugucccaucaaaauuggaaguauagcauucugguaagugaaagacuaaaacaaggaaguccagggcuuaaaaaaaaaaaaaaacuuauagcuaguuaaacuacaacacguuaaaauauccuccuaagugagccaggaguuugguagcagguguccagcugaagacuuggugacagagucuauuuaaauguaagaacauggcugauuauuucuuauagaagaaguuggauuccauggguuccaagagaagaagagcuaccuccccuuccagcagugucagcggggacuuugaugaugggcaccauucugugucaacaccaggcccaagcaggaaaaggaggagacuuuccaaucuuccaacuguagauccugugaguaacuuggauuacaugguuucugccugcucuucccacaauuccccuaucuucccuuuaaugguaaaauuguuacgaugcaaggcaucuccacuuuuuuaagauucucuugauuaauagucuuuucuuuuaugaacauuauguauucagcuaagucuuagaguaauagugugaucuuaugaauaauuucaguauguuacaucauauauuaauucagcaaauaacugugugacuaucaugugacaagcacuguucucaugguugggauauagccauguggaaacaagcccauuuuucacauggaacuuagauuccaggcgggggaaguagaauguaaacaaguaaacgaauaaagaauaauguauccuuagcuaguaauaagugcuaagaagaaaauuuugggugauuugggcuguuuuggccugaauucgcuggaagagaguuccagacagaaccagugcagagggguugggucagggaugaguuuugugugucuugguuacagagcaggggauggucaggaaggagaaggaaacuggcaagcuccacccauucagaguauguagggcccacacaagcaauguuuggaguuuagauuuuauucucugugaagugauaaacccuucugucagauggcuuuaagcaagagagugauaaacugauuuaguuucaaagaagaaaacccuucaauuggaugacuuuaagcaagaaagugaugaacugauauaguuuagaagacaaaaucaccaggagcauaaaucugaugaaagauaccaaaaaguuagucaacucaguuguuugaaaggagacauauugucagcauauuucagacuuuagcauguuugguaauauugagagucaucauuuuucuucucuacuugccuuuuauugaagaguagaaaauaauucuuaugucuacacuggcuuucuguucacuuuuuuagugauuuuuuucuccuuugcuaauguguagauugccgugugccaugaacucuauaauaccauccgagacuauaaggaugaacagggcagacuucucugugagcucuucauuagggcaccaaagcgaaggugaguucgaagcacaucaguacaguugcgggggauuugguccagaguccauguguauuaaaguguuuggaaauugagcuuuuuguuggcaggaauggcuuaaaugauacugggguccaauuuuagucuuuagucuuuaguaaucaagcuguagugaagcuuuuuuuaaauuaaaaaucuguugagccaggcacaguaacaugcaccuauaaucccagcuacuugauuuuuugagccaggcacaggagcaugcacuuguaaucccagcuacaugggagacuaaggcaagagaauugcuugauccaaggaguaugacaccagccugggcaacauaaugagaccccgucucuuaaaaacaaaaacaaaaaaaaugaccuaugcggaaagaucucuugaggccaagaauuugagaccagccugggcaacauagugagacccaucucuacaaaaaauuuuuugaaaaauuagccaggugugguggugcucaccuauagacccagcuacuagggaggcuggggugguaggauuguuugagccugggaauuugaggcugcaguaagccaugagugucacugcacuccaaccugggugauggagcaagagcuugccuaaaaauaaauauuuaaaaaagaguacugaccaggcacaguggcucacgccuguaaucccaccacuuugggaggucuauaggugggcaaaucaccugaggccaggaguucgagaccagccuggccaacauggcaaaacccugucucuacuaaaaaauacaaaaauuagccaggugcaaggcugggcgcaauggcucauuccuguaauccuagcacuuugggaggcgaaggcggguggaucagcugaggucagcaguuugagaccagccuggccaacguggugaaaccccgucucuacuaaaaauacaaaaauuagccaggcuugguggugggcgccuguaaucccagcuacuugggagacugaggcaggagaaucacuugaacccgggagguggagguugcagugagccgagaucguaccguugcacuccagccuuggugacaagagugaaacuccaucucaaaaaaaaaaaaaaaaaaaaagccgagcauggugguggggcgccuguaaucccagcuacuugggaggcugaggcaggagaauugcuugaaccugggaggcagagguugcagugagcugagaucccgccacuguauuccagccugggugauagagccauucuguagguugccuuuucauuuuguacgguguccuuagauguacaaaagguuuuaauuuucaugaaguuuauguugucuuuuucucuuguugccugugccuuuggugucauauccaugaaauuaaugccaaauccaauaucaugaagcuuuuccccuauguuuuuguauuaaucaggguucucuuggacaggacuaggcugcaaauuuuccaaacuuuuaugcucugcuucccuuauaaaacugaaugccuuaaacaguacccaacucaccucuugaaugcuuugcugcuuagaaguuucuucugccagauacccuaaaucaucuuucucaaguucaaacuuccacagaucucuagagcaggggcgaaaugccccagucucuuugcuaaaacauaacaaaagucaccuuuacuccaauucccagcaaguuccucaucuccaucugagaccaccucagccuggaccuuauuguccguauuguuaucaggcuuuuggucaaagccauucaagucucuaggaaguuccaaacucccacauuuuccugucuucuucugagcccuccaaacuguugcauccucugccuguuauccaguuccaaagucgcuuccacauuuucggguaucuuuucagcagcgcccaacucuacugguaucaauuuacuguaucaguugguuuucacacugcugauaaagacauacccgagacugggaagaaaaagagguuuaacugaacuuacaguuccauauggcuggggaggccucagaaucauggugggaggugaaaggcacuucuuacaucaguggcaagagaaaaauaagcaagaagcaaaagugggaaccccuaauaaacccaucagaucucaugcaacuuaaucacuaucacgagaauagcacgggaaagacuggccuccaugauucaguuaccucccucugggucccucccacaacaugugggaauucuaggagauaacaauucaagcugagauuugaauggggauacagccaaacuguauugguuuuccucuaagaguuuuauaguuuuagcucuuacauuuaggccuuugauccauuuugaauuuuuauaaguaguguuuagguaaggaucccgcuucauucauuauuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucucccgccucagccucccaaguagcugggacuacaggcgcccgccacuacgcccggcuaauuuuuuguauuuuuaguagagacgggguuucaccauuuuagccgggauggucucgaucuccugaccucgugauccgcccgccucggccucccaaagugcugggauuacaggcgugagccaccgcgcccggcccccgcuucauucuuuauauguguguauccaguuuucccgguaucguuuguugaaaagacugugcuuuucucauugaaugguuuuggcgccuuugucaaaauuugcuugaccguguaugugagggucguuucuaggcuccauucuauuccauuggucccugugucuguuuuuauaccaguagcacacauuuugauuacugugaacaacauauucaguggcaaaauacuuaaagcuuuuccucuaagaucacgaacaagacagagaugcccacuuucaccacuucaacaccuuguucacuguggaauaaaucccaccugguuaugguauauaauccuuuuaauauccugcugaauucaguuugcuaauauuuuauugagaaauuuugcaucaguauucauaagggauauugaucaguaguuuucuuguaguaucuuugucuggcuuugguaucagaguaaugcuagcuucauagaauaaguuaggacgugaccucgccucuucaauuuuuuggaaaaguuucauaaggcuugguguguuaguucuugaaaugucugguuagaauucaucagugaagcuaucagucuagggauuuucuuugugggagauuuuuuauuacugauucagucuccuuacuaguuauagguuuacucaggcuuuguaugucuuuaguagguuguguguuucuaggaaauuauccauuucuucuaguuuaucuaauuuguuggcauacauguuuuccuagaacucucauaauccuuuuuauuuuuguggcauugguuguaaugucuccucuuuaugauuuuaguuauuugcaucucuuuucucccuuacuucuucccucccucccuccuccuuucugucuuuuuuugagacaggaucuugcuuuggcacccaggcuggagugcaguggcaaucacaguucagugcagacucaaccucccggacucaagcaguccucucaccugaugcuaccauaccuggcuaauauauauguuauauauacguguguauguauauaguaaacacauaaaauauauauauuguauauauaacguauuuuuuauuuauauauguaaaaauaugcuggauucuuaccuaacgcuacauacauauuaaaaaauaacguauguaauguuagguaaggagauauauguguguguguguguguauauauauauauauauauauauuuuuuuuuuuuuuuuugguagagacaggguuucccuguguugcccaggcuggucucaaacuccugggcucaagugauccuccuaccuuggccucccgaagugcuaggaucacaagugugagccaccacacccagccucucucucucuuuuuuuuuuuuuuuuuugagauggaguuucgcaccaggcuggagugcaguggugcgaucucgauuguggcucaccacaaccuccguuucccagguucaagcgauucuccugccccagcuucccgaguagcugggauuacaggcaugggccaccacgcccagcuaauuuuguauuuuuaguagagacaggguuucucuauguuggucaggcuggucucaaacucccgaccuuaggugauccgccuaccuuggccuuccaaagugcuggcauuacaggcgugagccaccgugcucagcucuuucuuucuuaguuaaucuagcuaaguguuuaccaauuuuguugaucuuuuaaaaaaaccaacuguuuaauuuuuaaaauuguuuuucuauucucuaauuucguuuaucugcauucuauauauauaucuauauauauauuuuuuuuuugagacagugucuugcucuguugcccaggcuggagugcaguggcgugaucauggcuuauugcagccucugccuuccagguucaagugauucuuaugcuucagccucccaaguagcugggauuacaggcgugugccaccaugccuggcuaauuuuuguauuuuuaguagagauaggguuucacuuuguugcccaggcuggucuuaaacucuugaccucaagugaucuguccaccucauccucccaaagugcugggauuauaggcaugaacuacugcacuggcccuccuuucuauuuauuaucuacugcuagcuuuggguuuaguuugcucuucuuuucucuaauuccuugagaaagaagcuuuuuuuuuuuuuuuuuuuuugagauggagucccacucuguugcccaggcuggagugcaguggcacagucuuggcucacugcaacuuccaccuccuggguucaagcaauuguccugccucagccucccgaguagcugggauuacaggcauacaccacuaugccuggcuaauuuuuuuuguacuuuuaguagagacggaguuuugccauauuggccaggcaggucucgaacuccugaccucaggugauccacccgccucagccucccaaagugcugggauuacaggcaugagccacugcaccuggccgagagugaagcauguuuuuuaaauuauuuaauuuuuuuguuucauuuuguuuuuuaacaccugguucacauaggcaguauaaaaauuaauaguucuuauggcugggcgcgguggcucaugccuguaaucccaucacuuugggaggcugaggcggguggaucacuugaggucaggaguucgagaccagccuggccaacauagugaaacccugucucuacuaaaaaugcaaaaauuagccgggcgugguggugggugccuguaaucccagccacuugggaggcugaggugggagaauugcuugaacccgggaggcggagguugcagugagcugagauugcaccauugcacuccagccuggacaauaagagcaaaacuccgucucaaaaaaauuaaaaauuaauaaaaaaaauuaauagcucuuaagacuguauugaaguugucacagugauaguuaaaagggaucaguuuuuuaaauuacacagagaggcaucuugcacacaacuuccuauggaagguauguuccccuaacuagaacaucuuuccucucuugcugucaaaauauaaucacuauucucuucaaaacucuggcaauuggccaggcgugguggcucaugccuguaaucccaacacuuugggaggccgagacagguggaucaccugagugcaggaguucgagaccagccugaccaacauggagaaagcccaucucuacuaaaaauacaaaauuagccgggcgugguggugugcaccuauaaucucagcuacucgggaggcugaggcaggagaaucacuugaacccaggaggcagagguugcagugugcggagauaacgcuguugcacuccagccugggcaacaagagugaaacucugacucaaaaaaaaaaaaaaaaaaaagccaaaaaaaaaccucuggaaauugaaguuauuuguucugaaaacguauaugaguguguuagucagaaaacuggugcccaaauauuuccacauucuaaucccugaaaccugugaauauauuguguuacauggcagaggggaauuaaguuugcuaaucagcugaucuugaauuggagcgguuauccuggauuauccauguggguccaguguaaucacaaggguccuuaaauggggaagagggagacaaguucagucagagauuugaagaugcuguagugcuggcuuugaagauggaggaaggagacuacaagccaagggaugcaggugagcucuagaagcugaaaaaggcaaggaaaccuuuuucgcuagaugcuccguacuagaacauccagacggcaugcagcccugcuaauaccuugauuuuagaccagugagacccauuuuggacuucugaccucuagaacuaauauaauaaauggguuuuguuuuaagcccugaaguuugugguaauuuguuacagcagcuguagaaagcugugaguuaacuaaagauuuagauucauucaugauuguugaugcuacaguggguaguuaccaagcucuaaguugaacuggaggcaaauuucucaccucaacgagcaagccacugagaaugcagugucaucauccugaauuaggagagcccuguaaauuagcaaauuagccauggccaaaaaggaagcauuguuuuuaaaaugagguaacugucuccauauuugaguugguuuaucaauaauagucuucugaaaguugucauuuaauuagcauaaaguaguaaaagcauguauuuauuguuugccacauucuagacacaauaccaagcauuuucccaaucauaucuuauuuaaaauucugaguuaucacaguuuauaggugagaacuugcacaaguucuuguaacuacuaaaagauaacugguguucagacuaaagucguucugacuccaaagccugugcucuuaaccauuaugugguauagaguagcagcaucacacugaaguauacaaaacaacuuuuauagaagauaccgucccucugcugccuccuuuuugcuggcaggcgagugcugaggggcagaggauacacaccuugggugcuggaccacugucauguuacaaccucgaagauaauggugccuuuuuucugacgcuccucuguggaauguauguuuuuuucucaaguauuuaugagaauuaguauugcucagagcuacacaauuugugaauaucuuuuugauacuuuguuucaguuacuguauuagucugcuuugugcuaggacaugcaaaucaacaauggcugaaacaaaagagaaauuuauuucucuuguguaaaaguccuguucugugaaguugucaagguacaaguauuagccaacucuauucugcggucuuugugguaucacccuugccugcauggucugagaugacucacuaccacaacugccuuccagccaguauggaaaaagaaugaauguuaaggacaugacuuggauaugacacacuucagcucucguauuggcuagaaucuagcugcagugaggcuggagaauaaauauggucuuuaagguuuuguuuugcuuuguuuuccuuagagacgagguuuuaccaugucacauaggcuggaaugcaggcuacucaccagcaccaucuuugcacacuacagccuugaccuccugggcucaagcaguccucccucagccucccaaguagcugggacuacaggcaugcaacaccaugcuggcugagaauauagucuuuaguagccaugcagcagcuuagaaugcugucauccugggaagaagggaaaaugggguagggaguagccggcaggcugucugcacaccagggcuaguguuucucauuauucugauuaaaacuuugcauuuugguuauuuugcagccauaugccagacugcccucaucuauuguugaaagagaaaaguuguuuugaaagaacauacaauauaauccuguuuauguuaaauuugguuuguguguacaugugccuauagagaagucuggaagaaugucuauaaaaaugcaaauggugcuauuuauucuggauuauaaggaugauucuuacuuuugaugguuuucuguauguuugauuucagaaaaaauuaguacuguuagaaauuagaaguauuucauuuugaaauggggggacccuguuuugaccauaugacauagagugagagguugggauccugauuuuucuuuugucuuugugguaauucuaaaaauguuugugaggaaccuuguagcagugauucugggggauaguguccuuucuaggcacauguucucauugaauucucaauugucuacagauaguccccuuagcuugagacacugcugggguccugccucagcaaggagcacuggacuguggguccuguaggcccagauggagaggaccaucuuggauauuaaguuaucagagcccuaaugugugcugugagaagguuccuugauaccacugacaacaucaguauucuuucugcuuuuucucugauuucucaauauucugauuuuuuugguugaaaagaguucccauauaaguggaccugcacaguucaguggucaacuguacuguauuaacauucacuuccugguuuugaugguugaguugugguccuuauuugugagaaacaaacacuaaauuaucaggcgugauggggcaucaugucagagcuuauucaaaugguucagaaaaaaaguacuauuuuugcaacuuuuaugucagaauacaaauuuaaaaauaauuuaaauauauuauacguaauaaaagaauggcuauaaccugucagcuaagguuccaagagagauuuaagccuuaaucgccaugauguuauuuguaauaacuuaucucuuacacaucuagaauggggcugaauaccuaccccugugggagaauugagaaaauagucacaucguuuuucaguagguuuacuugucuccuggaacuucauuugaagaaagccagaaaaaauacuaaacauccaugaacccuaaacccaagaaguuauuuugggaacuuaagaaauugucauuaaaauuacuuaaggaauuaaagaaggaaauuacuuaauuauuuuaagaaauuuugucauuauaauuaccuacaaaguuucuuguguguuccucacuaccccucuccugcaagguauaaccacuaagccaaauuuuguauuucuuagucccaugguuuuuuuuuuccgaagaguuugguuguguuuagauguaucugauguccauucaucuuuguuaagcuacguaagccaagggcucaucuuccucccuuguaauuuuaguaauugcuauuguagcagcauuuaugauaggcauuugauaguacuuggcagaaaaaauuuauguggucacuuacugaagaaagaaucuguuuuguaaguuuauaaagaguauugagacauaucucuguuuucacacuuuugagcacuaugaaagguaagucaucuucauuuauaaaggauaccauugacauggguuuagcguuggugcccuaaacauuaaacaguuagcauauaaaagaccaucacagguguuaauuuagguuuuuauaucauuaacguauguuuugaaaagggaaugagugugcaucuugcuuuucuuuuucuuuuuuugcagauuuuuuucuuuuuuuuuuuuuuuuaaguaagcuucaaaguccaugaaagauucuaauaugcucugucacuuggaauguugaacauuaccauaaauaguuuugaaauaaaacuuuuuguaagcuucagauuaaucuccuuuaaaaaaauuuaaauuauaacagaaaucaaccagacuauuaugaagugguuucucagcccauugacuugaugaaaauccaacagaaacuaaaaauggaagaguaugaugauguuaauuugcugacugcugacuuccagcuucuuuuuaacaaugcaaaguccuauuauaagguaagaaauuaugaaauuuggaaagauaccaauuggaagauaccaauuugauaauuggcuucuuaauauuuauaaaccuggcaggugaguaguaguuucuuuuuguggcuugaguucgcauuugucuuauucguaaagagacuggacauucauaugauuuuuauuucuuauuuauuuacguauuuuaauuuauuaucuuuugagacagggucuugcucuguuacacgggcuggagugcaguggugagaucuuggcucauggcagccuccgccucccagguucaagcaauccucccaccucacccuucugaguagcuggcacuauaggcacgugccaccaugcccagcuaauuuuugcauguuuuguagagaccaggguuucaccauguugcccaggcuggucuugaacuccugggcucaagcaaucugccugccuuggccucccaaagugcagggauuaugggcgugagccacugugcccaacccacauucaugugauuaugaacuauucuuauuucucugucugcucaaaucuuuugcccauuuuucucuugguuuguuagucauuuucauauuucuggaauuuuuuuuucuuuuuuuuuuuagagacagagucucccuauguuacucaggcuggucucaaacuccuggccucaagugauccuccugccucagccucaugaguagcugggacuacagacaugagccaccacuccuggcuuuagaaauuuuuuuuuuuuuuuuuuuuuuuugaggcaaagucuauugcccaggcuagagugcaguggcacgaucucagcucacugcaaccucuucuucccagguucaagugauucuccugcuucagccuccugaguagcugggauuacaggugcccaccaccaugccuggcuaauuuuuguauuuuuaguggagaugggguuucaccauguuggccaggcuagucuugaacuccugaccucaagugauccacccaccuuggccucccaaagugcugggacaacaggcgugagcgaccaugccuggccauagaaauuuuuuaauuauuguggauaguaaaccuuuuuugauuauauguguuucaguuuuuuuauuuuuuuuauuugauuuuguguguuucaaauaucuucucccacugugugcauaucuuuucaccuuucaugguauuuuuugaugaacagaaauguuuuauuuuaguuuaaucaaauuuaucaaucuuuaaauuggguuuauuuguaucuuguuucagagauuccucuugcccaagauauucuucuauuaguaugcuuuucuuaaaguuuuauaguuuugucuuucauauaagccuuuaaugcagcuaggauugauuuuugucuuuuauaagguaggaauaaaugcagcugggauugauuuuugucuuuuauaagguaggaaucaauuuuuuucccacagguauaaccaacacuauucucucugcguuuguucgcaaucguugcugucaucauuuccauguauucauggaucuguuucuguccuuuuauucuguuccacaggccaguuuaucuguuacuaggccguucuauuucuaucuuaauuacuuuggcuuuauaauuuuuuuuuuuuuuuuuugagacacgaucuccuuuguugcccaggcuggagugcaguggugugaucuuggcucacuacagcccuugucuccugggcucaagcaaucuucccaccuuagccuccugauuagcugggacuacaggugcgcaccaucacacauggcuaauuuuuuguauuuuugauagagacgggauuucaccguguugcccaggcuagucuugaacuccugggcucaagcgauugacccgccucggucucccaagugcugggauuacaggcaugaaccaccaugcccagcuugcuuuauacuucuuuuucugguuagaaaguagguuaauuauacuugacccuuugccauuucuuuuuuuuuuuugagauggagucucgcucuguugcccaggcuggagugcaguggcgcgaucucggcucacugcaagcucugccuuccagguucacgccauucuccugccucagccucccgaguagcugggauuauaggcacccaccaucaugccuggcuaauuuuuguauuuuuacgugguuuugccauguuggccaggcugguccugaacuccugaccucaggugaucugccugccucggccucccaaaagugcuaggauuacaggcgugagccaccaugccuggccuuauuuuuaagagaugaggucucauuaaguugccgaggccagaaucaaacuccuggacuuaagcagucaucccaccucagccuaccagguagcuaggacugcagguacacaccaccuugcucaguuuauuuuacucuucagugcauuuuguuauuuuuuucucuaugccuucuuuugauuucauuuuuuucaaaacuuuuuuccucuuauuaccucuaaaauuuggaaauuguaacaucuauagauaaucuuuuaguucuuaucuaagaaguuuuaauaugcauaauuaacuuauucaaagccagaagcuaaucaggaucuuaauccuccaaacaauacgaagacuuuagaauaauucaacucugaucacucuuuuccuuauuuauaaugcuggugcuguguacuuuaguucuuuuguggcaauuuuugaaucugauagaacagugguccccaagcuuuuuggcaccagggaccaguuuugcggaagacaauucuuccauggacagcaguggauguagggggcagggucaggaugaaacucuuccuucucaugucaucaggcauuagauucuuauaaggagcucacagccuagaucucuugcaugcucaguucacaauaggguucacacuccuaugagaaucuaaugccacugcugaugugacaggaggagcucaggcgauaaugcugucuugccugcugcucaccuccugcugugcggcccaguuccaaacaggccauggacugguaguuguucgugggcuggggguuggggaccccugccauaaaauacuauucagccaggcaugauggcucaugccuauaaucccagcgcuuugggagguugaggcaggaggauugcuugaagccaagagugugaaaccagccuaggcaguguacuaagaccccaccucuacaaaaaaaaaaaaaauuguuuuaauuggcugagcauggugacgugcaccaguagucccagcuacuugaggggcugagguggaaggaucauuugagcccaagaguucaaggccguaaugugcuaugaucaugccacugcacuucagccugggcaacagugagauccugucuuuaaaaacaauaauaauaauaauauugauuuguggagucaguaccauucauuauuacuacuuucuuuauucuucauuccauuuugcuauugagaagucauccgccaguaugauuguaguuccuuuaaagguuaucugucuuuucuuuucuggcugucuuuaguauccuuuucucuuuuguauuuuguaguuucauugugauauauuuagauguggauaucuuuauagaauuugcgaguaguaaugcuucauaaaucuuagauugguguuucucaucaucuuuggaaaguuuuuagccaugucuuugcauuuugccuuugcccuguucuuguaguaacucugauugggugucauauuagacuucccacaggucuccauuucucuuaacuuuucauauuuccugcuuuugugucuguguuuccuuuuuuuuucuuuuuuuuuuugugauagagucuggcucugaugcccaggcuggagugcaguggugugaucuuggcucacugcuuccucugccuccuggguugaagcgauucuccugccucagccccugaguagcugggauuacaggcgccugccaccaugcccggcuaauuuuuguauuuuaguagagacaggguuucaccacguuggccaggcuggacuugaacucccgaccucaggugauccacucgccucagccucccaaagugcugggauuacaggcgugagccaccgcgcccagcgucuguguugcuuuuuagauaaucuuuuuuuuuuuuuuuuuucaguucuuucaauuuucuuggugaaaucucuuaaauuaguuaaauauaaauuuaguauuugcauuuuaauuuuucuacauauaggaaguagcgucuuuuuuagagucuguaggacuuugcucauuguuuucaaacucauuguuucuuuaaacuuuuuauuuauuuauuuauuuuuuuaaagagagaaagucuugcucugucacccaggcuggagugcacuggcuauucacaggcacaguuguagcucacugcagccuuaaacuccugggcuuaaguuauccuccugccucagccaccuaaguagcuaggacuacaggugugcgccaccgugcccaacuuuuuuuuuuuuuuuugagacggagucuggcuuugucacccaggcuggaguucaguggcgcuaucucggcuuacugcaagcuccgccuccccgguucacgccauucuccugccucagccucccaaguagcugggacuacaggcacccaccaccacacccagcuaauuuuuuuguauuuucaguagagaugagguuucacuguguuagccaggauggucuuaaucuucugaccccaugaucccccugcuucagccucccaaaguggugggauuacaggcgugagccaccacgccuggccaccaugcccaacuuuuaaacauuuuuaacacaccuguuuuuuauucuaugguagauuauucugauaaucuaauuauuugaauuccaauaucuaauacauauauuuguugucacugucauuuuugcuagcuuucucgugauucuuugauucuuaugugccucaugauuuuuuuacuauggacucaauauuucuuggaacuuuaucuguagagaucauuggagcauuaaauugaaguugguuucauccagaaaugauuuguuucuuguccaggaugacuggccugucuuuguuaaggcuaacuuuacgaugaagaguucucagagauucauuucaugccucuccucuccucucagugccaugguuugagauaggcaugaauuuagauagguagagguugagaugggcagucguccuugcucccuggcaguacagaaacugauuugaguucccacuaauggugcagccauggccuuuggauucccagcuucugguagacccugaccuuugucuucccuccucgcugcccagagaagccuuggaaaugaaagcuugguuuuaucauaaauaaaugcccucaaagugaacauuugacuuaaguguuguggguuuucaucugguuuccuacuuuuauuccuuuaauuuugugaacauccuuacuuccuauuggcaucccauguaugcauuuuuaaaguuuuauuuuauuuuuugaacauugcauccaacguuguuuuuacuagaagauuucagucaagaguuuauuaugcccacuauacuucaugagcagacauuuugaaacaagguauuaaagaauuucaaaccacaaguauuaauaacaucagaaccgucauuagcuucuauccuuuaaaucaaaucuuauccuuuaaguugucuuucuuaguguauuaguaauaauuaguuuuuuuggguuuuuugguguuuuuuuuuuuuuuuuuaagacagagucuugcucugucaccaggcuggagugcaguggcgcaaucucggcucacugcaaccucugccucucugguucaagugauucuccugccucagccucccaaguagcugggaccacaggugcguaccaccacgcccagcuaauuuuuguauuuuuaguagagacgggguuucaccauguuggccaggauggucucgaucucuugaccucaugauccaccugccuuggccucccaaagugcugggauuacaggcaugagccacugugcccggucauaauuacuuuuaauuuagcaaaucauuugucuucugccucaagucuuucuuuaaugagauaagaccuaaauaauuugauuucagaaugucuuuaaaacauacacuuaauuuuuuggaagcgggauuuggacccauauauguuuuaaucaugaggauguuaaaauuuguaacaauuuuuggucuuugcugaaacaggugcuuuaaaaguagcaacuaauuuccaauacauuacuaaaguguuuuuuuuuuucucuuugcuaacauacagccagauucuccugaauauaaagccgcuugcaaacucugggauuuguaccuucgaacaagaaaugaguuuguucagaaaggagaagcagaugacgaagaugaugaugaagaugggcaagacaaucagggcacagugacugaaggaguaaguguguagcuggaacuugugauggaugggcucuuggaaggcagagagggccccugcuugugauucccucugggcuguugugggcaacuagaauuccugugcaauuguauugguaacugggaggauaaaaggacauucagccagagagccccacuccauuuuuaagggauccuaggauauccuggacaacgugugccaugugugguaauuuucaugaauuguacuuacauuaaugcauauuuccugcucaguuuuaaagagaaucuugauauuaucaaggauuaguccaguauugcuacauugagacaucauguaaggaaaggcaguguugugauuagaaguuggaauguaaucaccuuagugaggaauauuucuguagguuagaauaguuacuguuccuagaaccucccagguguguuucugccucuggaauuuugcaguuguucuucugcauagaaagugcuuccuuugacuuuucccgugacuggcucuuuuuuauuguucuaacaccaucuaaaauggugucuacugagacaggacuuuccugaccacccuaucuccauuguuugcuccgccuuccuccuuuucagccccuaccccacccugucaucacaggguugucuucaguuuuuauaaugucacuauaugugaaauaacauacuaguuuacauguuuuucucucuuuccccaaguagaaugauagcuccuaagcagguaucuuuuuguucauuuauuccucauaucugcacuauaccugacauguaggugcugauaaauauuuacuaaauaaagacacaugcuucauggccaggcgagguggcucacaccuguaaucccagcacuuugggaggccaaggcgggaggaucacuugagguuaggaguucaagaacagccugaccaacaugguaaaacccugucucuaccaaaaauacaaaaauuagcuaggcagguggcacaugccuguaaucccagcuacucuggaggcugaggcaggauaaucgcuugaacccaggagguggagggugcagugagccgagauggcgccacuguacuccagacugggcgacagaaugagacuccaucucaaaaaaaaaugaaagacagaaaauaaaaagacauguuugaaaagagaaaaaagaauaguagaggggaucacaacucuuuucuacagcuaaauugugagaagcacauugcagaauauuccccuuucuucuguaacuuaucuacauaggccuuuugcuggaauacagagaagcagugaugggugaauuucucaaaaauacaauuacuucuuagagucucaaaauacaguuccuagucaggugcuguggcucaccccuguaaucccagcacuuugggaggccaaggcaggcagaucaccugaggucaggaguuugagaccagccuggccaacauggugaaaccccauuucuacuaaaaauacaaaaauuagcugggcaugguggugggcaccuguaaucccugcuacucgggaggcugaggcaggagaaucgcuugaacccgggaggcagagguugcaaugagcugagaucaugccacuguacucuagccugggucuuagaaugagacucugucuaaaaaaaauauagauagauagauagauagauauacacaaaauauauauacacacauauacauguaguucauauauuuuauauguauaaaauuuuauauuuuauauaugauauguaaauauauguauauaguuccucagcagcuugucaguuucuuuaaguaguuaagugauuggaacuaaauagaaggcuaaaaauaggaauuuccuggaauuuuacucucuaauaugaauacaggagaagcagcccaugcuuucuucgguagaacacugcuugcagaggccccacccuuaguguaggccuucagggcucuagucaaaagauuaaaaugccuguauuuaggacuugcccguacuucuguaacgcauaauugaugagaaauugggagggucuuguacauucacauuuauaccucccaagccucuuucaaauuuuguuuuuuugagacagugucuugcucuuuggcccaggcuggagugcaauggcacgaucacagcucacugcaaccuccaccucuuggguucaaacgauucuucugccucagccuccugaguagcugcgauugcagaugccugucaccacaccagcuaauuuuuguauuuuuaguauaagugagguuucaccauguuggccagacuggucucgaacucuugaccucaggugauccucccacuucaccuucccaaagugcuugggauuacaggcaugagccaccaugccagaccccaagacucuuuauaacucaaugauucucauggagggagaagaaauuuucagguuucuaauuuuuaaaucaaggaugauuuucuugggucuggugcgguggcucacgccugcaaucccaacacuuuaggaagcugagacuggaggaucacuugagcccaaguguuugagaccagccugggcaauguagugagacgcccaugucuacaaaaaguaaaaaaauuagccaagcauggugguacacaucuguggucccagcuacuugaaaaacugaugugggaggauugcuugagcccuggaguuagaggcugcagugagccauggucacaccacuucacuccaaccugggcaacagaguggggaggaaaaaaaaguguugcaccuuaaaauugagacuauacuaaauaaaaagagcuucuguuggauuaggacacaauaccaguacuuuuaugauuuaaaccagaaaaaaaauuacucuuuauuuuauauguacaaaaaaugauuuggacuagaagcauaauuuaauccuugacugagacauuccauugcuuauucuagaaacuugcuucagacuuggacccucccuggucaaguacucuuuggggcauauacuuccuauguugaaacagugacuaagcuagguauaaaccagugggucuaaagaacagaaaugguguacauugauguacuuaaucgcuguuuaguuuugacuuaauuugaauucaguuagacuugguagagcaccccgugguuaaaaguauguagucccaacucuauguaaguagucauuguccuguaaguagucauuguccuguaagacuucaauagaugugaacagcagauauagaaaugaacuauuaugggacaugcuuucuccugcucaguugcucauuucacauuuguagcacuuaaacuuugccauugcaauauuuacuguagaaaaagguucaguagaaggaccuaguacaagggauuucauugcaaaaauaauauaaggcaccucauuagguucauauagguuguucuagggauacaaugccuauguccagcaucagaacauuaugggguauucuugaaauuuggaguuaaaauaaguacugcuuagaaguugcuuucuuuggccaggcacaguggcucaugccuguaaucccagcacuuugagaggccgaagugggcagacaugaggugaggaguucgagaccagccuggccaacauagugaaaccccgucucuacuaaaaaaauaaaauuuagcugggccugguggcgcaugccuauaaucccagcuacucgggaggcugaggcaggagaauuacuuaaacccaggagguggagguugcagugagcugaaauugugccacuguacuccagccucuccaucucaaaaaaaaaaaaaaaaguugcuguuuugaauuagcucuacaauuuuagaagcuauguaauauucagcauuuuauuauuucucuuagaaaguacuuuuuucuccacauuaccagucuucuccagcuuacuugaaggagauccuggagcagcuucuugaagccauaguuguagcuacaaauccaucaggacgucucauuagcgaacuuuuucagaaacugccuucuaaagugguaagugaugcaguuaaaaacagguacaugucaguguuuuguuuuuaguacuucaagaauuguauuaauuacugauaaauaaaguaaguucaaaaggaagauguugggccgggugugguggcucaugccuguaaucccagcacuuugggaggccgaggcagguggaucaucugagguugggaguucgagaccaucccgaucaacauggagaaaccccaucucuacuaaaaauacaaaaaauuagcugggugugguggcgcaugccuauaaucccagcuacucgggagggugagguaggagaauugcuugaacccuggaggcagagguugcagugggugagccaagauugcgccauugcacuccagccugggcaacaagagcgaaacuccgucucaaauuuaaaaaaaaaaaaagaaaaggaagauguugggccaggcgcaguggcucacgccuguaaucccagcacuuugggaggccaagacaggcagaucaccugaggucaggaguuugagaccagccuggccaauguggugaaaacccaucccuaguaaaaguauaaaaucuacccuggugugauggugugugccuguaaucccaccuacucgggaggcugaggcaggagaauugcuugaaccugggagguggaaguuacagugagcugacaucaugccguugcacuccagccugggugacagagcaagaguccaucucaaaaaauaaauaaauaaaaggaagauguuggaggcccccaagagauccuccucacagcagcacaaaauguauacggucuaucauuuuacaugaucagaagguuaugauuuuauuuuuuuauuuuuacguuuuuuguuuuuugauugguaauuauuuuuauuuguuucuuauugugguaaaggauauguaucauaaaauuuaucauuuuagccauuuuuaaguguacaguucuguggcauuaaguacauucacauuuuuaugcaaccaucaccacuaucuggaacuuuuuagucuuacaaaaccaaaacuccauacccauuaaacaccaaguccacuccccucuucucccagcuucuggcagccaccauucugcuuucugucuaugaauuugacuauucuagguacgucauagaagaagaaucauucaauauuuguccugugacugcuuauuucacuuagcauauguucaggauucaucuauauuguagccugaaucagaauuucauuccuuuuuagaaccgaauagcauuuuguuauuucuauauaauaccuuuuguuuauaaguuuuuugggguguuuuguuuuguuuagagauagagucuugcuguguugccuaggcugaccucaaacuucugggcucaagcgauucucccaccucagccucccaaguagcuggguauacaggcuugugccaccgugccuuacuacauuuuguuuacucauucaucugucaauggacauuggguuguuuccaagauugguaauucuucauugauaaaauaagcacuuuaacuaaaucuuuuuuauuuauuuauuaauuguugagacggagucucguucugucacccaggcugaagugcaauggcgugaucuuggcucacugcaaccuccgccucccgaguucaagcgauuguccugccucagccucccaaguagcugggauuacaggcaugcaccaccacaccuggcuaauuuuuguauuuuuuaguagagacaagcuuucaccauguuggccaggcugaucuuaaacuccugaccucaagugaugcaccugccucagccucccagagugcugggauuacagacaugagcuacuacacccggccuaaaccuugcauuuuuaagaguggaaacuuucucuuuguguaggggacaggguaagaggaagauaaaugaguucuuccuccuuuuaauucucuuugaucuccuggugaugcugaaaaaagaaaaacgaauuagguacucuucugccugaaaaaagaagagguuuucuagacaagcaagaccuuuaaaaaguaucagaauucuuuaugccuuuacacccaaaagauaauuaacauauagauuugacucacauuagccuaugaaacugcaaacauuuucauggccucagcauucucauauuucuagguaaggauauacuuucagaaguacuccaugguagcacuuagcccuauugugaucauuuacuuuucugucugccuucuuuucuacucccugaauuucuugaggacagugacugugcuguaauuuaccuuuguauuacugucuauaacuggaacccgauccgaaggauuggaugacuuuggauuacuuuguaccccaugcuggguggucauagauaugcaagaugcuuguugacugaugaguagcaugcagcuuuccucaucagucauuggcaagacuauaguuauuuaaaggugugucuugacuagcuauaggauaguuacaacauuagaaauaaagcaacugaccacugcuguccuaugugugaaucuuacuagaaagauguaauuauuaauauuggucauaugacuuaaaacuuuaagaaaaggagaaaacaguaugaugauucucuagagaauuaaacauggaauuaccauaugauccagcaguuccacuuuagauauauacuccaaagaaagugaaagcaggguauugaagagauauuuguauacccauauucauagcagcauuauucacaauagcuaaaaauggaagcaacucagguguccaucagugaaugaauguauaugugacauauacauacaguggcauauuauuuggcguuaaaaaggaaggaaauucugaaacauccuacauggaugaacucuaaagacauuauuuuaagcaaaaugagccagucacaaaaggacaaauacuguaugauuucuuauaugagguaccuagaauacucaaaaucuuagagacauaaaguuagaauggugguugccaggggcuggagggaauggggaguuguuuaauauguacagaguuuccauuuugcaagauuaaaaaguucuggagguggaugucagugauaguugcacagcagugugaguguaccucaugccacagaacuguacacuuaaaaauggcaaauuucauguuacuacaugaaauuuauuuuauuacaguaaaaaaaauuauaaaagaaguacaggauagguguagugacccacaccuguaaucccagagcuuugagaggccaacauagcugagacucugucucuacaaaaaaaauuuuuuuaauuagcuagucaugguggugugcaccuguagucacagcuguuugguggggcugaguuuggaggaucacuugagccuaggaguucaaggccgcagugagcugugaucaugccacuucacuccaaccuaggcaacagaaagagaccccgucucuuuuucucucucucgcucucugucaacucucauucacacaugcacacauacacacaaaauagaaguacugucuucgcucaagauuuauucuuacccugcaggagauaaucagugauggucaaaucaacaacagugauauggggcaaugaaacaucaauaauuaguuccccccauucccccuucaaggucaccuugaaggagcugguugggaaaagcagguuucuauuggucucucagggugugacaguuugaaagacaacaaggauugacagcugaaggggcaggacaguuuucaccuuuccuuaguaaguccgucccaagcaagcuggcugcaugggagagauagauugggaauuugugggauuggaugacuuugaauuacuuuguacuccaugcuggguggccuugccauaauuuguccucugaacuuucucucagaaguagaacuggugaagagaaggggcagcaauggagauucauccaaguaaaggaaggaguaggguuaagaaaguagugguaagcuuaggggacagaugagauaaaacaacacugagauaaucuguucagcccaguaacugagugaaggcuguggcuuucugcuuuuguuguugcugcgugggcuucaguaggguuugaacaggugggaagaguugggagagcacaaucugacuuccccugaaccucucccaucugauaagaccaacuuuugauauuugggcaacuucaguuauuuccuccaaggaagaaaaucuguaggaaagccugagugcagugagugauucuagguuguugugaaagcuucaaggacauuccucaacauguucaauuucuugggaugaccuaguauuugauaaaucagaaguugcuaauaauuuugcuucauuucuuuucuuuuuucaagacagucuugcucugucacccaggcuggagugcaguggcgugaucucagcccacugcaaccucugccucccagguucaagcgauucuccugccucagccuccugaguagcuggaauuacaggcacccgccaccacacccagcuaauuuuuguauuuuuaguagagacgggguuucaccauauuggccaggcuggucuugaacuccugaccucgugaucugcccgucucggccucccgaagugcagggauuacaggcaugagccaccaugccugaccagaauuuugcuucauuucuuucuuucuuuuuuuuuuuuuugagacagaauucugcucuucuugcccaggcuggagugcaauggagcaaucucagcucacugcaaccuccaccucccagguucaagcgauucuccugccucagccucccaaguagcugggauuacaugcaugcaccaacauaccaggcuaauuuugaauuuuuaguagagaugggguuucaccauguuggccaggcuagucucgaacuccugacuucaggugauccacccaccucagccucccaaagugcugggauuacaggcgcgagccaccaugcccagccgugcuucauuucuuuaacaaaguuucauucaaaagguauuuuguuuugaaaaaacuuacuuugacugaaauaagcagaagcaucaaguuaaacaugaagcuaacaaauuuugcaaccugacuucuuacagauccuuaugaaaguuuaugugaauauuauauaauaacguuauuuagauugcaaaauuaaaagagcuuguaacaaacuccuaaagagcauuucuucuacuuuauuucuaggcauagauaucuugggaccuuaaaugaaaaauuguauaauucugugaauuuagaauuuuuguuuguuuuuugagacggaaucuugcucuguugcacaggcuggaguacaauggcgugaucucggcucacugcaaccuccaucuccugcgcucaagugauugcccugccuuagccuccugaguagcugggauuacaggcgcacaccaccaugccuggcuaauuuuuguauuuuuaauggagacaggguuucgcuauguuggccagguuggucuugaacuucugaccucaagugauccagcugccucagcaucccgaagugcugggauuacaggugugagccaccgcgccuugccgaauuuagauuauuuauuuuuuuuuugagauggagucuugcugugccgcccaggcuggagugcaguggcaugaucucggcucgcugcaaccucugccucuuggguucaagcgauucuccucccucagccuccagaguagcugggacuauaguuguaugccaccaugcccagccaauuuuuuuucuauuuuuaguagagacaggguuucaccacguuagccaggauggucucaaucuccugaccucgugaaccacccgccucggccucccaaaguucugggauuacaggugugagccaccgugcccugccuagaauuuuuuuuuuuuuuuuugagacgaagucucuuucuugucccccaggcuggaguauaauggcacgaucucagcucacugcaaucucugccucccagguucaagcgauccucuugccucagccuccugaguagcugggauuacaggugccugccaccacgcccggcuaauuuuuguauuuuuaguagagaugggguuucaccauguuggccaggcuggucuugaacuccugaccucaggugauccaccugccucggccucccaaagugcugggauugcaggcgugagcuaccgcacccggccccagccuagaauuuuuuaaaacauuaaauuuuaugcuaguugcauaauaacacucaaaauaccaaguuuuaacuccuaagucaugcuguuggauagaucaugaagcuucuuaagauuaaauucuuuaugguucugauauaauaaaugugcuguacagccaugucuuuagucuugaaucucacaaagcugcuucacugguuguuugaacaacagauugucaauguacuuccuucucuuuucauuagcugaauaguuuaacuuauugagcaugccugguuuuuugucuuccagcaauauccagauuauuaugcaauaauuaaggagccuauagaucucaagaccauugcccagaggauacagguaugaagaugaccauaaguaaaugauugugguuuagagcagauuggccuaugaucuuuccuagaagcuuuuagaaaacagagaagcuaguugucucuguaagggguuauuagcaaaucauguaaauaaauuaaaauaguguuacugauuguagcuuuggauugcaucuuaggacaaaaauuaaaacacauugguuaccgacauuucugauuauaaaagauacauuugugacaaaagauuuauuucauuuuuaauuuuuaaauuuuuuauuuuugugggugcauagcagguguauguauuuaugggguacaugaaauuuugauacuggcauacagugcauaauaaucacaucaggguagaugggguaaccuguuguuuauuuuuaucugcuuccaaauagcuuuaggauacguuagaauaaaagcuacccacaacggauguuagaguggaaggucaguggaauuagauacuacuuuuuucucuuuggcccucucuacccuaccccuucacuguaucccuggcaguaaauaguggcaacuaaacacucacauagacuugcuauguaccuagcacuguuuuaagugcuuuauguguauuagcuaauuaauucuuaaaacuccacagaguaguauuguuauuauucccauuuuacaaguuagaaaacugaagcacagaaguguuaaguaacuugcccaaaucaccgccuaggaaggagaacuaggauuugaauccagacagucuagcuguagucuguguucucaacccuuacacuuacuguuucuguacagaguaggugcuuaauaaauauuaauugugugacugagugacuaggauuuaaaauuugauuauuagaaguaagggaaaguauagggaaaaagagcuaaauuguaccagaaauugaguauuuagaguagaacugauaugguuguuuuucuagcucuacuacuuaaucagcuaugucacuuuggucaggugauuugccugcuuccucugcuguauguugcguguaguaucacuacuuugcagagucauagagguuggugauaauauagauaaagcaucucacauagaaccuacagcaugagguccucauaaaugugaguuacugaucuucccaggauaagaaggguuugcugcucccaggagguaaggcaaaaaggaaaacaguguguuacauaguuucauugagaaaugagacugauagccacugugguuugccaggaaggagaaacuucuuugacuuuaaacucuaagagaguaguaaagaguaacaguguuuacuuacuaguaccacagauaaauuuucacagaaugauaaaauacagauucccuaauguaucaucuuuuuuuuuuuuuaggguuuuuuuuuuuuuuuuuuuugagacagucuugcccugucacccaggcuggagugcaguggcaugaucucaccucacugcaaaccuccaccucuuggacucaagucauucuccugccucagccucccgaguagcugggauuauaggcgccugccaccaaaccuggcugauuuuuguauuuuuaauagagacaggguuucaccauguuggccaggcugaucucgaacuccugacuucaagugauccacccgccuuggccucccaaagugcauagagauuauaggugugagccacccugccaggccucaucagguuuuuaaaucagcccaauaacuguuacugagaaugacucaagucuccuaaaucccuggaauuucuaacaucuguguaggaggauuauguuuucauaauccuggaaauugaaucagaucuuuaaucaucucuaucucagccccagucuucucuuuuugacuucucgccuuauuuuguccuuucuucuuuccaaaagucucagagucaccuuuugccaucacccgauucaagguccuuguccucuuauguccaaauuacuggaauaaucuauuuuaccucucugaugaaaaacuuucuaguccuuucugugucuuggcuccugaccuuggcuuucuuccugccagucccgugcucagagacuuaauucacuuguuuuccaaugccugcuaaagcaugucacaacuccuuguaccaguugaauaaaaccaacucugacuaauuuaaguggaaaaggaauuuuugaaaagcauauuggauagcucauagaaauguugagaagaaagguugaggaacuagccuuuggauacuaggcagaacucaggaacaucauggcacagcugagaucaugcacagccucuuuguggugccauugcuguuaccacuguaauuugccacuguggucccuggauacuugcugcucuacugcuagacucuccuccucuacaggagucaggaaugaauuccuggccauugcauuaaucccuuuagacccaagcaugaauuagcugaccugugguuauuuccccuugcccuggcugccaggcugcuggcaaagugaccauuugcccacuuacauccucauuaugggagguagagcccucccgaugccugugcugauucccuccguguaagaaggaugcguaguuguugguagucccacgaggcaaauagcuacacuccuuugccuggcucucuggauucugccucuuuuguuuuuacccucucugugcuuauggcucuacccuucuccaccuuccauuucgcucaguuugguuuccuuacucucucuagaccaugucuuuuucauuuccauguacuuaccauuagucaugugugccucuuaccuaaaaguguguccgucuuucauuuccuucguaaauuuaggcaacuauaugaguauuccuggguuguuuuggauugagugagccuuaagauaugacagcucuagcacacaguagguacucagaaaauguuagccucugugcuggacugauuucauauuuuaccccaagugguucauguaacuagggggaguuuugcuucacacuauuaaauccacuuuaaagaauuaguauucaugaagcacuuagaacugugcuuggcacauaguaagcacuauguguuuguaaaauaaaacuucuaccuuauuugacuuuuuaaaaauuguaauuuauuuuuaugagaauaaugcagcucugguuuuguuaccuaucucaaaaacuuacuuauaaauggguacaguaauaauuuauaaaaaagaaaaugacuuuacauguuguucauauguguacuuuccaauaaagucuuggaauauggugacaauuuagaaauaugugggguucuuuuuuuaaagguuguacugaugaacucucauuaaaaggaacugcuauauuuuguuguuuauuguagaauggaagcuacaaaaguauucaugcaauggccaaagauauagaucuccucgcaaaaaaugccaaaacuuauaaugagccuggcucucaaguauucaagguuaguuuuguuguuguuguuguuguuguuuuccuugguaauaguagauaauuuaaggucaguaauuuuuauaaaacaacuuuauugagauauaauucacauaccauggacuuuacccauuaaaaguguuuaauuuaggcugggcgcaguggcucacgccuguaaucccggcacuuugugaagccuagguggguggaucacgaggucaggcguuccagaccagccuggccaacauagugaaaccccaucuuuacuaaaaauacaaaaauuagcugggcgugguggcaggcgccuguaaucccagccaaucgggaggcugagguaggagagucgguugaauccgggaggcagagguugcagugagcugagauugcacuccagcccgggcgacagugcaagacucugucucaaaaagaaaaaaaaaaaaguauuuaauguaaugguuuuuauuauauucauggaguugggcagccaucacuccagucaauuaacagucgcccuuuauguccccccaacuucucuagcccuaagcaaccucaaaucuauuuucagucucuguguuugccuguugccauuuuacacaaauggaaucguauaauaugugauauggauuuuuugcgacuagauuccuucaguuagcguaauguuuucaggguuuauccauuuuguagcaugugucaguacuauguucuuuuuauugcggaauaauauucuacuauagggauauacacuguauuuuauuuacccauucaucaguugauagauauuuggauaguuucuacuuauuggcuauuauaaauaaugcuguugugaauguucacauauacguuuuuauguggacauauaaauacuacauauauauauauauauauauauauauauauauuuuuuuuuuuuuuuuuuuuuuuuuuuuucucuuugauacauaccuaggaauggaauugcggggccaugugugguaacuguauauuuaacuuucugaagaaccgccaaacuguuuuccaaacucuaccauuuuacauucccaccagcaauauccagguguugccauuucuccacuuccucaccaacacuuguuuuccauuuuuguuuuuguucuuauuauggauauccuagggagugugcagugguauggcauugugguuuugauugacaucucccuaaugauuagugaugcagaacaucuuuuuauuuuauucuuuauuuugauuuuuaggucauucauacgucuuuagagaaauguucagaucauuugcccauuuuuuaauuguguuacuguuuuuuuguuguugaguuguaagaguucuuuauauguucuggauauuauacccuuaucauguaaaugguuugcaaauauuuucucccauucucuugucuuuucacuuuugugauugugucuguugacacacagaaguuuuucauuuugaaguucacuuuaucuauuuuuuucuuugguugcuaaugcuuaagugucauaucaaauaaaucauucccuaauccaaaaucacaaagauuuacaccuauguuuucuuguaagaaguuuauaguuuagcucuuaacguacuuagaucuuugauccaguuugaaguaauuuuuauauaugugagguacauguaagguaggaguccaaauucauucuuugauaugagauauuaucccagcacuauauauagaaaagauuauucuuuccccauugaauugucuugaauugucuuggcaacuuuguuagaaaucaauugaccauagauguauggguuuauuucuagauucuugguucuauuccacucaccuaaauuucuguccuuaugccagacuugguuaguuuugaauccauuuuuuaguuaaauauugacuuauucccugcauuuaaacuucauaaauauaaaaagcaaucuguguagugcaguacacaauguaaaaugacuguuucauugcuuugcaaauuccaucuuagaaguuuuaugguucuguaaugaauaauugcuuguagaaauuuauugaauuaaucguguaucauugggaauuugccaaaggagacucagaaaaucuuuugggaauaaaaucauuuaaauuuucugaaugcugacucaaauacucaaaauugcuguugguauuuaaugauaacuuuuauuuuucaucuuuuaagaaauucugagagaaaaucaggaaugaacuaugaaguccuuguauuccuagucccuaauaggacauuuuaauaauauacaguacuaauuguuuguuguuacaguuaagaauuuuacuuuugggucuaauuauuuuuucuaacuaaguuuuaaagagaagggaaacuuaagcaaguacauucauucuaaacuuguguauauaaucuuuaaucuuagaagugcaucuguauuuugauuuuuaggucagcguacacaaguagaguuaguuguccguagucccucaccuuaucugcgguuuugcuuucguaugguucugaggucagaaaauauuaaauggaaaauuccagaaauaagcacuucauaaguuuaaauugcacaccauucugaguauugugaugaaauucaugccauccacuucuguccuaucuggucucaccugggacaugaaucauuccuuuguucagucuauccacacuauauacaccaccugccguuagucacuguguagccaucucgguuaucagcucgacugcugugguaucacagugcuuauguucaaguaaccuuauuuuacuuaauaauggccccaaaacacaagaguugugaugcuggcaauucaagaagcuuuaaagugcucccuuuaagugaaaaggugaaaguucuugacuuaagaaaggaaaaaaaaaaaaaaaagguaugcugagauugcuaagaucuacaguaagaacaaaucucccagcugggcacucugguuuaggccuguaaucccagcacuuugagaggccaaggcaggaggaucacuugaagauagggguuugagaccagcccggucuacaugguaagacucugucuccaccaaaaaaaaaaaagaaagaaagaaaaaaagaugaaucugcuauucaugaaauuguaaagaaggaaaaaaaagaaguuucugcuaguuuuauuguugcaccucagacugcaaaaaguuacagccacagugcaugaaaagugcuucauuaauauggaaaaggaauuacauuuguggauggaagacauagacagaaauguguuccagguuuggcaauguucaagguuucaggcauccacugggggucuuggaauguauccuccacggacaguggggcauuacuguauuauaccauuagaucuuugucuaaauauuacuugacuaaucaugaaagaacuaggaggcauuuuaacuuauauuuaauuagugacaacuuuaugaagauagauauuuuggaagcuuguagaaauguuggaggaugcagcuuuguggguauugaauggaagucugcuccaaguagaaagagugccauagaaggugcccauugcaugaguugggggcauuaagcuguccuuuuaucuguuccuuuuuuaaaccaaguaauuuuaucuugacaggaugcaaauucaauuaaaaaaauauuuuauaugaaaaaggcugaaauugaacaucaugaaauggcuaagucaagucuucgaaugagguagguuuaagaaaaugucuaggcugggcgugguggcucaugccuguaaucucagcacuuugggaggcugaggugggcggaucacgaggucaagagaucgagaccauccuggccaacauggugaaaccccaucucuacuaaaaauacaaaaauuagccgggcgugguggcauaugccuguagucacagcuacuugggaggcugaggcaggagaauugcuugaacccgggaggcagagguuacagugagcugagaccgcaccacugcacuccagccugguaacagagcgagacucggucucaaaaaaaaaagaaaaugucuaaaacccuuaaugccuuuauauuugcugaguuuucuagguagugaaaucaauaaacauuaacacgguuuauguugcauuucaaggugauacuuacaguugauauuauaauucugaagauaguaguaacucuuagcaccuuugcugcugaagggcuucauuuaacuagaaacauuuuuuaaaacuuuacaucacuauauacuuuguacaaauauuauugcuuuguacaaauaugaauauacauauauaauauaugguauauauuaauauuacacagaauagauaauaguaugguauuuauauauaauauuaguaguauguauucauauuuuugguaaggcuauuuagcagguaucaggagauccagucucauccuggcuuuuccuuguacuaggacugugauuuuuuuuuuuugagacagagucucacucuguugcccaaacuggauugcaguggcacaaucucggcccacugcaaccuccaccucccagguucaagcaauucuuuugccuuagccucccaaguagcugggacuucaggcacacaccaccaugcccggcuaaucuuuuuguauuuuuaguagagacaggguuucacuauguuggccaggcuggucuugaacuccugaccuugugauccacccgccucggccucccaaagugcugggauuacaggcgugagccacugcgcccggccaggacugugaucuugaacuagucuuaguucuaggauugcauuucucccuaccugaaaugggaagguugggugacuacuuucaaagcuuuccucuggccuugacauuguuucaguaccagguccucuggucacugcagugaccaaaagcucucuaggaccagcccuggucuguucuuccccgcagaguccccagggccugaagcagagucugcugcauaguagaaguucagaaguauuuuagcauuucuauuuagaagagaagaaaaugguuguguguguguuuguuuacccagcacucuaauuucagcuaccaaguuucuaagcuuuuuaucuuaucucuggauaggacuccauccaacuuggcugcagccagacugacagguccuucacacaguaaaggcagccuuggugaagagagaaaucccacuagcaaguauuaccggugagaaaaagaguguuuagucugagaguugaccugugcuuauaaagauaggcauacuaguauuugcccaauggcuaucuugaaggaauauuuuuggguauaguuugguuguuaaugagaaucuguugucaaaugguuuauuuaaaagguugaguuacuagggugggcacaguggcucacgccuguaaucccagcacuuugggaggcugauacgggugaaucacuugagaucagguguuccagaccagccuggccaacauggugaaacuccaucuauacuaaaaacuacaaaaauuagcugggugugguggcgggugccuguaaucccagcuacuugggaggcugaggcaggagaaucgcuugaacucgggaggcggaguuugcagugagccgacaucguggcacagcacuccagccagggcaacagagggaaacuccaucucaaaaaaaaaaaaaaaauugaauuacuaacguaggccuuauaucaccucucagacgaugcuuaagcauuguuucucaggcaggcaguguuuaauauuagcuaccaauaaaaugugagguuaaauacuaauagguuuuuuaaauucauaauagaauuuuuuguuuguuugguuuuugguuuuuuuuuuuuuuuuuuuugagacgaaguuugcucucguugcccaggcuggagugcaguggcacaaucucugcaaccucugccuccuggauucaagugauucgccugccucagccucccgaauagcugggauuacaggugccuacuaccacacccggcuaauuuuuuguauuuuuaguagagaugggguuucaccauguuggccaggcuggucucaaacuccugaccucagguguuccaccugccucggccucccaaagugcugggauuacaggcaugagccaccacgcccagccucauaauagaauuuguauuguaaaauaugaacaucuuagaagauaauuaucagcaacugugacugaguccuuauuuuccacucccucuuuucuaagaggaaaaaaauaguuuccucggcuaagauugauuaugagaaccauuaaguacagagauaaacuaaggaggcaauugaauagaaauuauuuuucuuucaucuuaacacuuuguuaauaguuccuguucccuguaaaguaaccuaauuauuauaacauccuucccugucuaauugcuuuuuuuuuuuuuguaguaauaaaagagcaguacaaggaggucguuuaucagcaauuacaauggcacuucaauauggcucagaaagugaagaagaugcugcuuuagcugguaggcauuagguuuugacuagcgaaaugccuucuuaguggauccuucuagcuaaaugaaauugcagugauuuuuucuggccuaggguuugcugguuugggaaguacaugcuauuuuauugcauuugauuguacucugguagucagaccuaucaaaagguuaaugcuuuaucuugucuuaaaacucauauuuggguaaauaauacuucugcaaaaauaauugauaacuuagcagauccugguuuaaaaccuauaaugauaaauagugaguacuaguaaaagcaucagaaaaucucagaaauccacauucaucuuagauuuucaggcuuuagcuuauauuuucaguaugcucuaauuucuucuuggcuugucuuucucuuaaguuugauauaauauuuuccccuuuacuauagauuuuuuuauguguaaagauaaaauuuguuucauuaaauuauucugguauauucuuuucuuucuuucuuuuuuuuuucuuuuuuuuuuuuuuuuugagauggagucucgcucuguugcccaggcuggagugcaguggugugaccuuagcucacugcaacguccgccugccggguucaagugauucuccugccucagccuccugaguaacugggacuacagacacgcgccaccacaccuggcuaauuuuuguguuuuuacuagagacgggguuuuaccacauuggccaggcuggucuugaacuucuguccucaugauccaccugccucggccuccgaaugugcugggauuacaccacgccuggccucaauuuuauuauugaauguuacacaacagacuucuccaguuguaucuuguuuuuaacuaaaucuccuauagaaauuucauaaucacuauaggcuauuauguauaaauuuacuuuuuugaaacauugaucuacagaauuaaguauuuuuuuauuuaaauugggccuggucuuaucagaaauugaaaaaauauuaucuucuuguuagcauuguuuuuuacugauuauaaaagugacacacggccgggcauaguggcucacaccugugaucucagcacuuugggaggcugagggggguggaucacuugaggucaggaguucaagaccagccuggccaacauggugaaaccgugucucuacuaaaaauacaaaaaauuggccagguaugguggagcgcaccuguagucucagcuacucggaaggcuuaggaagaucacuugaaccgaggaaguggagacugcaguaaaccgagaucacaccacuguacuccagccugggcaacagagcaagacucugucuuggggggaagaaaaagagguuauauggcugguuacaagagacacaucaaauauaaaaacauaagaaaguugaaucuaaaaggauggauaagaccagguguggugacucacacccauaaucccagcacuuugggaggccuaggugggaggauugcuugagcccagaaguucaagaccagccugggcaacauggcaaaacgcugucucuacaaaaaauacaaaauuuauucaggcguguuggugcaugccuguauucccagcuacuugggaggcugagaugggaggauccugagcccagggagguugagccugaagugaucacaccacuccacuccagccugggcaacagagugagacccugucucaaaaaauaaauaaaaaauaaaaauaauaaaauugggcuuuugucuugaaaaaaagaaaaggauggcuaaaagauacaccaggcgaauaauaaccaggcgaauaauaaccagaguagcuacacugacuuuugauaagauggacuuucaaacagagaucauuacacagauaaaaaggauugccuaaugaugguagaagguuaauuucaucagcaaguuaaauuguagaagagcucaaaauauguaaaacaagcagaugaaacuuuacagagaaauucaaaacacuacccuuagucuggaagcccucuucucucaagagcuaaacagaaaacgaaugaagauagagauuugaacacacuucuucauguaaguauuuguuuccuauugcugcugacacaguaccacauacuuaguggcuuaaaacaaugcaggcugguacacuggcucacgccucuuaucccagcacuuuuagaggcugaggcaggagcaucacuugaguccagaaguuugagaccagccugcucgacauagaaacacccugccucuacaaaaaaaaaaaaaaaaauuuuuaaggcagggucucccucugucacccaggcuggagcaguggcgugaucuuggcucccuacaaccuccacuccugggcucaagcaguccucccaccucagccucccuaguagcugggaccacagguacuugccaccacacccagcuaauucuacaagaaaaauuuaaaaaauaagccauauguagcuacuccagaggcggaguugggaggaucacuugagccugggagguugaggcuacaaugagucgugaucccaccacugcacuccagcccugccuccaaaaaaaaaaagaaaagaaaggaaaccuuuaacaggaaagaucaauaaaaucaaaaguuauucuguuaaaacccuuaauaaaaauaagucugaggugagauugucaaaaaggcauaaauaaacaauauuggcggggaggagagcauacagaguuuuaaaaaagaaugugugaauaaggccaggcuugguggcucacgccuguaaucccggcacuuuuggagccugaggugggcagaucaccugacguugggaguucgagaccauccuggccaacauggagaaacuuucucugucucuacuauaaauacauauaguggcacaugccugcaaucccagguacuugggaggcugaggcagaagaauugcuugaacccgggaggcggagguugcugugagccaagauugugccauugcacuccagccuggacaacaagagcaaaacuuugucccccgccccccccccccaaaaaaaaaugugaauaacguuaugcaaauauauuuaaaaauuuagaugaccagauuucuagaaaauaagcaccuaaaauggauucaagaauaaaaaggcuggcucacaccuguaaucccaacacuuugggaggcagaggcaggaggaucacuugaguccaggaguucaagaccagccugggcaacauagcgagaccucaucucugcaaaaagaaaaagaaaaauuagccgggcgugguguggugcaugucuguaguccuaccuacuugguaggcuaaggcaggaggauugccugagcccaggaguucaaguuugccguaagcuaugauuauuccacuacacucuagccuuggcaacagaacgagacucugucucuuaaaaaaagagagaauacgaggucaggaauuugagaccagccugaccaacauggugaauccccgucucuacuaaaaauagaaaaauuagccaggcaugguggugcacgccuguaaucccagcugcucaggaggcugaggcaggagaauugcuugaacccaggaggcggagguugcagugagcugagaucacgccaucgcaccccagccuuggugacagagcgagacuccgucucaaaaaaaaaaaaaaagaauaaaaugaaauauucccacuuagaaaauaccaggccaaacauuuaaggaacagaauuuuaaauaaacucaugcagagaauagaaaaagagcuccgcaguucauucugugaaucuaacauaaccugugaaucuaauauaaccuagacaucaaaacugcacaaaauauaagcacacugucuagcaguguguauaaaagauaguauauaaggacacaguuggauuuaggauuagaaaagauaaaaguaaucuuuaccacaguaacaaauuauaagaguaaaaucauaugauuugcucagcagaugcauuugauaauuguuucaguucccauucaagauaaaaauuauuugcuaacuaguaagagagggggauauugauauaaaguaucuccuuuuuuucuuuuuucuuuucucuugagacggaguuucgcuguuguugcccaggcuggagugcaauggcgcaauccccgcucauggcaaccucugccucccagguucaagugauucuccugccucagccuccggguagcuaggauuauaggagcccgucaccaugcccggcuaauuuuuuuuuuuuuuuuuuuuuuuuguauuuuuaguagagacaugguuuugccauguuggccaggcugaucucgaacuccuggccucaaaugauccgcccgccucagccucccaaagugcuaggauuacaagcaugagcuacugcgcccagccuucuuuuuuucuugagacuggguuuuacugugucacccaggcuggagugcaguggcgugaucucagcucacugcaaccuccaccuccgaggcucaagcaaucuuuccacaucagccucuggcguagcugggaccacaggcacaugccaccacacccagcaaauuuuuuauauuugugauagagauggaguuucaucauuuugcccauacuggucucaaacgccugagcucaggcaggcuacccaccucugccucucgaauuguugggguuacaugugugagccacagugcccaccaaggguaucuccauuuuuaauggagaaaagguaacagcauuucccuuaccaacagaaacaagguaauacuguuaccuuuguuggucacaguacuagccagccuacagugacaacaauaagguguaaggaucagaaaagauguauaaggauuacaguugacaguuuuuuuaaaagaugccgcuuacaguagcaacaaaauauauaccuagguguaaauccaacugcaggcucuuuaggggagagaucagagguauuagagucagaaaagacuaguuucaaauucuuaucugcuucuagcuccaugacucugguuccuaauccccuucaacugcuuuaugugguggcugaacuugugcaaguaauuaaccucauaugcccaguuuucccauuugaaaaagaaauaauacccaucuuguguguugguuuuaggauuaccugaggcugguacuuaucaagcucuuaacacauaauuaaauucuuuuuuuuuuuuuuaaggcggagucucacucugucgcccaggcaggauuacaagugugagucacugcgccuggccuaauuaaauucuuuuuuuuuuuuuuuuuuuuuuuuuuuuuggagacagaguuucacucuuuugcccaggcuggaguacagugguguaaucccugcuuacuacaaucuccgccuucugguuucaagugauucuccugccucagccucccgaguagcugggauuacagucaccugccaccacacccggcuaauuuuuuuuauuuuuaguagagacgggguuucaucauguuggccaggcuggucuugaacuacugaccucaugauuugcccgccuuggccucccaaagugcugggauuacaggcaugagccaccgugcccagccuaaauucuuaauaaaugauuaugguucuuaccugagaguacauagcaacuauauguuuauucugauccaucaagaaaaauuuaaauuaugguccuuacacacuguuuaggaguuuggggaaaugagcaacauauuuuuuauuuuuauaaaaauaauuacguuuuguuugcuuugguguuuuuaugauuugcuucuaccuaaaaauucccucagcaagggaauaguccugggggauguuuuaaaucagugggcaaagucacagagauuuaaggcuaaaucaugucugauagaaucagcccaaucuaggcugggcgugguggcucacgccuguaaucccagcacuuugggaggccgaggcgggcagaucacgaggucaggagaucgagaccauccuggcuaauauggugaaaccccaucucuacuaaaaauacaaaaaaaaaccaaauuggccaggcgugguggcacaugccuguagucccagcuacucaggaggcugaggcaggagaaucauuugaacucaggaggcggagguugcagugagccaggaucacgccacugcacuccagccuggcgacagagugagaccccgucucaaaaauaaauaaauaagaaauaaauaaaaaagaaucagcccaaucuaaauuuauacuaucuuaaacuucauguuacuguuuuaguucugggaucucugaaugguuacuugcuccuuuuggccaagcauagcaaacagucucugaagaaagcacauuucagaaagaaacuguuuugcaaccuuuaaaacuauuguacuuuuacuauuuaauauucuauuucuauguaauauuucucuaaacaugcaauuauguuaagccuuuuuagcauuaucuuuaauaaacauuugagagguuuuuuuguuuuuguauuuguuuuugagauggagucuucauccgucacccaggcuggaguacagugguguaaucucggcucacugcaaccuccgccuucuggguucaagcaauucuucugccucagccuccugaguagcugggauuacaggugcaugccaccaugcccagcuaauuuuuguauuuuuaguagagacgggguuucaccauguuggccacgcuggucucgaacuccugaccuugugauucacccaccuuggccucucaaaagugcugggauuacaggcgugagccaucacacccagccuuagagacuauuuuuuuaaaguaauuauucccuuuaucuuagaauuuuuuuaaaaaagggccaggcgugguggcucacaccuguaaucccagcacuuuaggaggcugaggcuggcagauugccuaagcucaggaccuugagaccagucugggcaacaugacgaaaccccaucucuacugaaaaauccaaaaauuagcugggugugauggugugcaccugucuucuuagcuacucgggagacugaucugggagaacugcuugagucccagaggcagagacugcagggagccaagaucgcacccuugcacuccagccugggugacaaagccagacccugucucaaaaauaauaguaauaauaguuuucaaauauauuuaguucaaucuggaagguuguuaaaugaacuuuaaaguaugguucuuucuucaucucauucgucccuuuauaaauacuuuuuuugucuuuccagcugcacgcuaugaagagggagagucagaagcagaaagcaucacuuccuuuauggauguuucaaauccuuuuuaucagcuuuaugacacaguuaggaguugucggaauaaccaagggcagcuaauagcugaaccuuuuuaccauuugccuucaaagaaaaaauacccugauuauuaccagcaaauuaaaaugcccauaucacuacaacagauccgguaagaugucuucuacauuauucaguauaauuuuauuuuguuguggcugagccugcacauaauguauuucuuccuaaaauggauaaggauauuaaagguaaaaaugguguuuuuuuuuaaccucaaauuuuaacuguucauuaccuuuuuuuuuuuuuuuuuuuuugagacggagucucagucuguugccagacuggagugcaguggcgugaucucggcucacugcaaccuccgccuccuggguucaggugauucucuugccucagccuccugaguagcugggacuacaggugcgcaccaccacacccaguuaauuuuuguauuucuauuagagacuggguuucaccacuuuggccaggauggucucgaucuccugaccucaugaucugcccaccucggccucccaaagugcugggauuacaggugugagccucuguacccagccuuaacuguucauuaucuuauaacugagcaaaguacgaaaaucuuucagccuaccucuuuuauuaauauuuuaauuaugacaguuaaucuguauuuaaguuauguaucuauaguugaaaccccaggauaagcauagucaguuccuggagaauucauuaaccgcaaccauaccagaaagaugauucaucuuguucucuuuuuucuauuuagaaaauguuaaagugaucauugggcuaccagacagaauacuuaaaucacaauagugucauuaaaaauaguaggacgucucaaccacaaaaaaaaacccaauucagaaaugggcaaaggucuugaauggaccuuucuccaaggaaaauauacagcuggcuaauaagcacaugaaaaggugcucagcaucacuaauuauuaggaaaaugcaguucagaacuuuugugugauaccacuuugcacucauuaggaugguuacuuuaaaaaaguaauaauaauaauuauugguguguauguggagaaauuggaaccucugugcagauagugggaauguaaaaugguauagacgcuguggaaaacaguguggcaguuccucaaaaaauuaaacacagaauuaccaugugauuaagaaauuccauuuugcauauguaccccaaagaaaugaaagcagggucucaaagagguauuuguaaaccuguguucacagcagcagcauucacaauagcuaaaacauggaagcucaaguaugcaucaagagaugaggggauacgcaaaaugguguguacauacaauggaauauuauucaaucuuuaaaagaaauuuugaaacgcucuaacauggaugaagcuugaggacauuaugcuaagugaaauaacccagucacaaaauacaaauacugaaugauucuauugauaugaguauuugugcaaucagaagucauagagacauagacgcugauccagaacauuaaaaaaaaaaaucagagacaaaauagaauaguaguugccagggacuaggggaagagggaaacaggaaguuacuguuuaauggguauagagugucagucuuacaaaauggaaagaguucuagagauggauggucauauuaauugcauagcauuauggaaguauuuuauacuacuaaacuguacacuuaaaaauggucaagguaggcugggugcagaggcucacaccuauaaucccagcacuuugguuagccagugauuuggugggcaaaucacuugaggucaggaguuugagauuagcccggccaacauugugaaaccccgucuccauuaaaaguacaaaaauuagccaggcguaguggcaggagccaguaauccuagcuacucgggcggcugagguaggagaauugcuugaaccgggaagguggagguugcauugcagugagucuaggucgcaccacugcacuccagccugggugacagagugagacuccaucucuuaaaaaaaaaaaaaaaaaaggucaaggugguaaguuuuguguuauaccaaaauuuuucaaauugggggggauaguaaccuuuucuucagugcccauuuucuauccauaccucccaauaucaaauuugcuuuuuucuuuuuguuaaagagacagggucucugcucuguugcguaagcuggcaugaucaacucgaaccucugggcucaagggauccuucugccucagccucccaaguagcugggaccacagacacaugccaacaugcccagcuaauuuuuuuaaauguuuuuguagagaccaagucuugcuuguugcccaggucuugaauuucuggccuuaaauaauccucucaccucagccucccaaaauauugggauuccaggugugagccaccauacccggccuuuuaaaaucucuucugugaaagcuaaaaaaaauccauaaugucauggaguauauuuuuggacucuguaugauaucucugaaagucaaaaauccugauuuccagacagacacaaaauucaugagcuuuuaauuuauuuuuaaauagauccugaccuaguuucuguuucuguaaaaacagcagggucucaaagagguauuuguaaaccuguguucacagcagcagcauucacaauagcuaaaauuucuguuucuauaaaaagcagaauaggugaccauucccaaagaaucauaaaaauucaaaacauucaaaagaauaaauaucuuuaaggaaaguuaaccaaaaaucuuaaguuggaaucaaaugaauguguucaaaaucacuugguuugccuuccaucuuugaaucagucucugugaauuuugauauuaccuguacauuccaagcuccuuucuuacauuacaaauuuucaaagauauuuauugcuuucaggaaaucaauaaaaauucuuagacuuuuugguauaaagaacagaaaaauaguuuaauuggucccgcugugccuucuuguuuauuuaaauuaaaaauaaacuuaaaaauaucaaaaguuggccaggcgagguggcucacaucuguaaucccagcacuuugggaggcugacgugggaguaucacuugaacaugggagauggagguugcagugagccaagaucaugcugcugcacuccagccuggguaacagaguaagacccugucucaacaaaaagaaagaaguaauauuauaaaauaugaugcuuuauaguagaauacccagauagagucaagaagcagguaaaacuaccuuagcuaaguaacaguaaguuggcuucauggcagauauuuaaugugcuugcuggauucuaggaaauaaggcuggcuaacaaaguauguuucaugcuuuugcauuuguaacuuuuguuuucaccauuugaucaguaauaauuuuuuuuuuuuuuuaauagagaaaggguuuugccauauugcccaggcuggccucaaacuccugagcucaagcaaucugcccgccuugaccucccaaagugcugggauuacaggcgugagucaccacgccugacguugaucaguaggauuuauggugcuuuuauuuaauccagacuuuggagguccuguauacaaguaggauacagaagauuaguuuuuuuggucuuauuaaaauaacauggaaauuaaggcugagauucauuacagaaauagccuagaaauaugucuuuuauauucuuugcguugggaaaagauagugauagucuugcagauguuaagaaguucccuguccaaaauuuugaacaauuuuuguucuugguuuccuuucuccuucauuauuauuuuuaaauuauuuaaauagucuauuacaguagcuuaguucaaaagaagacaaauucuuagccagcucaguccccugccaacacagccuucuuccaaguugaaauuuucuaauauaaacuuugcuuuaagucaguaauaucuccccuccccuuucuaauuuauaauggcaauuguguggcacacaggggagaguaaggaauagggaaguuguugaagcccagcacacuaaaguucugaaggguaaacuauuaugucuaauguugcugccuuccgcggauugugagccaguggugccugacaggagccuuacugugccuacgaucccuuccauuguggucuacagagcaacagggaggucuaggggcagugcuauucaacagaacuuucugcguugaugaaaauguuuuauuaucaauauuccaaugugauagacacuagucauauguggcuauugagcacuugaaauguggcuagugugauuaaggaauuagauuuuaaguuuuauuuaauuuuaauuuaaauagccacacauggcuaguggcuacuauauuguacaguguaccccuaggaagaucuauuggcagaaggaagauaguugaguuuccccaaaagcaacaaaaauggaagaguaagcaggaacuagacaguguggacuccauaugcuaccuucugcuguacugggauuuguccccccuauuuuuuuuucuuuuuccucccccacuacccuugauuaauaguaaucugauaaauaucugcagguuuauuauucguugucauuugcaaguuuggguuuucugucuguuugaggguauugagaacaucuagcccucuacccuuugaguugacgggaacaagucugaggcuguaauuugaacucuaggugcuagcuacacaaccugguacugagagcugaauuugugcuuaguuguuguuugcuuugucacagagauguucucuaauauucaucuguuggagcacaacacagaaucugaauaugauuuugguaaauuuuaaauaaaacuuuacaugcagaugccauucuaagagaaaauucacuuauucugugaagcuguuuauacauauuauuguuaacugucuuugugauuuugaugguuaacgugcaaaugcuacaaucaaaagauuuaaagucuguccugucuaaauccauauaguguuacagcaaauagugacucuacuuuguacaaaguacauaagggcuuuaugauaguugauacaauaauaaugauuguguuuaagugagauacuuggaaucuuaagacuuuuaaguaaaaaucccagcuuuaagcugccaaguuauuauguguuuauauuggaagaauagaaaugaauggacucugacauaucuaucucucuuuuaccaucauaagaccacucuuuauuguuuauaaauacuuugcacugucaguacugucucuuuaacccuuaugaacuagaauggccuuuuauuuucagaaauggguagaucaccaugauuguucauugaggucacuuaaaaccucccuaauuuucgucccuucauaagguucacguaugaacuauuaggauuuuuccauuaggguuuuuuccaaguagaauguuugcuuuguaauugucuucuuugcuaggucuuuacuaggucuuauuauuauuucuuauaguguuuuaguuuauucuuuuggauuuucaaguaaacugucauauuaccuuaauguaauggugcuuuugccuccuuacuuuguaucucaaaagucauuuuuaaguuccuaaucaguauuaccaguaaagauaccauguagugcuugucaagauuuugcauuggacuuucaggaagaauguuucauaauuuucaugacagaaaauucuagcaauuucuuugucuuucacagaacaaaacugaagaaucaagaauaugaaacuuuagaucauuuggagugugaucugaauuuaauguuugaaaaugccaaacgcuauaaugugcccaauucagccaucuacaagcgaguucuaaaauugcagcaaguuaugcaggugugauuuauuguuuuugcugaguuuguuguauauaugauuaaaauaauuuugcauguuuugaguguguucuaguaagaugugugaucccccccacccucagcaguaauauuacaucauuuggcugggugcgguggcucacaccuguaaucccagcacuuugggaggucaaggugagagaaucacuagagcucaggaguucaagaccagcuugggcaacauagcgagacccccaucucuacaaaaacugcaaaaauuagccaguccugauggcacacgccuguagucccagcuacucaggaggcugcggugggaggguugcuuaagccugggaaguggagguugcagugagccgagauugcaccacugcacuccagcuugggcaaccaagugagacccugucucaaacaaacaaacaauauauauaauauauauauaaaauauguauuuuauauauuauacuuauguauuauaauauauauuuauuauguauuucauccucaaguacugcugaauuuuuuuuuuuuuuggaguugucauggccauauagaguagaaauaauaauugagaugggguuagccuucugauuggaggaagcagggauuggucccuguacaguaauuuugggauucucaugaagucacccugcaaucaccgaugauauuccaucauuuagauuuuauuccuuugguucuagacuuuguuaaaguagggcugauucuaucagaaaggacaucugaaagcaaauuaaucuuuguauauugucuaugaauuuaucagauccucucugagaacccuuggaaggaugucucaggucaugguucaucuagggguuuuaagaugaaaagguagauaugaaauacaaauugggucuaucugacaguuuuugguagaaucuuucuggaaaggcaaaucucugaacaaugaagcaacaaaggcaauuuuagaucacccauagaaucuucauuuuauaugauuaacagugaaccuuagugcugagacuuucagguauuauuaccuuuuuaguacucuguacauucccuaagccugcugugcuuggacuuucagcucuguuuggcagaaggccuuuaaaaaugcauguguugaaaaguagaucuuucacuucuugcauuaaacuuuauucuuagccacacugccccuuagaagucaggaguaccaaaggcccucuuugaguugguuuuacuuaaauaggacaaccagagcaggaugcuucuacagcuugccucagugcuuuuaaccaguuagcacccauuauagucauaaaugcucugcugguauugacuccucaacccuguagaaccauuuuuuaaccuacucuuuuugucaugcaggcuuuuguuaaaauugguuauugaaaauguuuaaugacucuuucauuuuguacauccugcaugugauuguauuuuucugagugaaucugauaugucuagcucuuuaacauucauauauucagaggaguguuuggcacaugagcucaacuccugagaucugcucuguuuuaggcaaagaagaaagagcuugccaggagagacgauaucgaggacggagacagcaugaucucuucagccaccucugauacugguagugccaaaagaaaaagguauauacucuucuuauagcuggggacaucucaguuccuguuaauuuuguuuuagauaagugaagaaaauauauauuuuuuaagcuaucaaguuguaagcuuuaaauaaaugguaauguguucucuuuuaaaauucauuugcaauuggaugauuagcuuuuuuuuuguaaaagugccauguuacuuuuagaugacccagaugaaaaugacuacuacauauguagcuuggcaaaacauguuauuccguuugccgucuggguuuuuuuuuuucuuuuaauguggcauuuuaagaaugccacuuaaaucuaacuuggguaauuucuacauggugaauuacaaaaaugcaauuugaauuaggaaagguaaggagaaauuugauacuaccacugcagugagguaugccauugguccuacccuuuguuuguccuuguucaccucaucuuuauuugccauuuuaagcaugucagauuauaaaauaacaaaucauaacuucuuauagcucauaaaauguugagcuagauuuuugggguuuuuuuuccuauauaaccuuucucucaacuucccuaaccguuucuccuucucacggguuuuguggaaggggaucuuacugugagauuccaaagcugggauccuauaaggaauuuugcaauauuaucucucgccacacaaaguuucucucgccugaucauuguggaacacuguauuguccuuuaaucaugacugccucaccaucuuugcagcaacagucaauccagggaagauaccuucaauaaggaauaagcuaaucacuaauagcaaggcuuggcagauucaaaguugaaugaagucuuuaguaacuguugacacagucuauacaugcauuaagagauccacuaagaagaauuuaaaaaguaguuuagaaaagaggagcuguccugcuuuccuucuuauagauagcauuuuggagaauuuuuuaagcuuuaccaugguaacuaaauugaucaguauacccugagaugugagucuccuccauuacuggccuaugaauuucauccuuccaaguucuuaauuccuuguuauaccagggacaauggaggaaaagugugaaaccagaucaaagacaucaaaucaagaacaagaacaacuuugaguguaaauauguaacucuacugcagcaucaccuguguuuuccagaucagucaccuaucaaagauaaaaacuuaucaggcaaaagaagguaauggaggcaaaagugaugguacaauuagugccaacacuggaugaaaagaaagaucuuaaauuaguugaguauuaagaaaacaguuccaacgaagcauuagcccaggccagauacucgaaaauuacauaccuguguggcuaguagucugugggacacucaaauaagcuaaaguuuuuggccaggcacaguggcacaugccuguaaucccagcauuuugggaggccgagccagguggaucacuugaggucaggaguuucgagaccagccuggacaacguggugaaaccucaucucuacuaaaaauacaaaaaaauuagccaggcgugauagugggcaccuguaaucccagcuacucgggaggcugaggcaggagaaucgcuugaaccugggaaguggagguugcagugagccgagauuguaccauugcacuccagccugggugacaagagcaaaacucugucucaaaaaaaaaaaaaaaaguuaagcauuauguucuuaauuuaaaaaaaucuuacuucagacaaaaagucucuuuacaaacagguuuccuaggaaguguuuuguacaaaugaagugaaaaacacaaauaaaagaacaauauaaaucauccacuaaaaaaauaaaagaaucugaguuugaaauguagacaugaguggacguuaaaagauugaaaggauuaagucuuauacuuuggacuaugaaaaaggaaauaacacgaucagucauguugagagguuuugguaauaagagauuucuucagaagucaggcagacaguagccuagaaaauuaagcuaaucuuggccacagaagucagggcuaaguuuuccaaguaccacuugacuugacuucuaagugcuguguaugauucugccuucgccuuuuuuuuaauacuaaagaaugugagaaaaauugauuguggguauauucucuucauucugggggugcauucuuucugccaacaucugucuuccuuguugaaauguuucaaauauugucuuugguacuuuggacugaauaaucuuuuucuucaaccauacaugguuuguacaugacccuccaauguugcuuguuuuguuucucuuuacauguaauguuuguuucugcuuucccaggaacacucaugacagugagauguugggucucaggaggcuauccaggugugcaguccuuuuuuaugcauaaacauucuuuuaaaguguaucuucuguggcaugaucaguacugauuaggugaaaagugaagccuuaagcaugugaaaaaaagucuuuauuggggugccaguuuauuuuaugaauaaagaaagcaguacaguuuaaaaaaucuuguuagcaaaauaaauucagaauuaaccuaguucagaaguagccuuaauuuguugcuagcuuugccagggacagaaggcccccucaccaaucauuguggcuguguuucuguagcaaaagguagaagguggcagugcuggugcaggacuggcaggugcugauucccuuucagggaugccuuuuacagauugagggugguggagggaucaaaaucagcuucacagucugagugacaucagugcauguggacaccuaugcauugggucagugcuucuugagcaugaauacauuuccucagucucugaucuuguucaugucuuuuauaaaaagcauucuuuugcauguuacuuaugauuugaaaacaaccuauguaauaauuguguagugcuuuuguuuucacauuugccgucugacauucacagaguaucaguugcuuauagaacacuaaacucugcucuuacaguuuauaaaggagaacauuuagucaucucuuuuaccugccaggaacauauaggccaaggaaagaggcagguugaaaacaaaugaagucauuuggaagcaagguaguaaaauaauugcauaagguacacuacuaagcaguuguauaggaucauugcaugauugcccagauagcuuuaggaaagauuauuuuccuaccauacuuucccuugaaaguugaaugucuugagcuuccccaaauguuacuaccauauguauuccacucaguaaaauugcuauguuaucauugucaucuuccuaauauuuuccuaaagaaaaguuuucuuaauuaaaugguaaauuuaagaaaaagaccauggauuguauucuuucauaucauucauaauguauggcauugaaacuaggugguaguggaaauaggaauagggggcaucacuggguaguguuacaacccugaguucuagagccugacugccuaaauuccaaucccagcuguucuuauuagcucuguaaucuaagccucauuucaacuuuaucugaaaaacaaguuaaugacaguaccuucauaggauuggugugaggauccaguuaguuaauauguuuaaagcucuuagaacugggucuggaugcacugaguacucaguaaauguagcuguuuauuuucuugaaguagcgcuuauugaccuauugaccuauugacuugguagauuuugguuuuguuuuuagucagauguuacuugucugggaagacucauuggaaaagaugaaugaaaagguuuuauuucuugaagacuugaaggugaaauauagcaagccuuguaaaagaaagaacguuuggguuuacuuagcuuacuaguaagcacaacugaagcucuuaaggugggggagcuaaaugcugggacaccuuaaagccuguaaacaggguugacuuugauuagagaggcuguugguaagugccagcuguuauuuuuuaggaaacagggucuugcuguguugcccagacuggagugcaguggcuauucacaggugugaugguggcacauuguagccucaaacuccugggcucaugugauccucccaccucagccuccugaguaguugagacuauaggcaugcaucacugugccgggcugugccaacuuuugggaaaggaagggacauaaaagcagcauggugauuaucagcugauucaaaugucuguucugguuguuuacuuuauggccuuagguauucauuugcugucucuaagccucaguuuuuacaucugcauaguugggguaauaauuauauuugauucugaauuugaagauuaaaugagagugcauaguguuuaacauuugguagaaguauuaguagcuauaguuuacaacuguauauaagaauuguguguguguguauuuguaaauauuaguauauauaaaaauaaauaguagcuuuagaggaagaauauugauaagggcauuugacaaaguggucagccacaaaguaugagagccaaggacuuacauuguggcaugaaacauuaaaaggaaaacaggauguagaagggcuguggaagucuucuagaacuugcugaucagccagggggagaaaaagugacugauuuagguguuucagauuggguuggguuccggaggauagugucgauggugauccuggaaaaucacauuugccaucacacaucagggauucagaauagagccucugcuagugcauaaacuuugugcaaauuagaaaaagcagccauuucucaagacacuugacuugcaugaauuggaaaauuguuguaauauacuuauuuugauagcacaggacccuuuaugucccauuuccuaugaaauucuaaaauuguagcguacuuacuacaacaguaucuaugaucugaauuguuguccuccuaaguauuuuuuugucuuucuuuuuuuuuauuuuuuugagauggagucucucccugucucccaggcuggagugcaguggcacgaucuuggcucacugcaaccuccgccuccuggguucaagugauuccccuaccucagccuccuaaguagcugggauacaggugcacgccaccacacccagcuaauuuuuguauuuuuaguagagacaggauuugccauguuggccaggcuggucucgaacuccugaccuuaggugaucugccugccucggccucucacagugcugggauuacaugugugagccaccaugcuuggccuuuuugucuuuuuugagacagucucacucuguugcccaggcuggagugcaguggcaccaucauggcucacugcagccgugaucuucuggguucaaacaauccucccaccucagccucauguguagcuaggaucacaggcaugugccaccaugccugacuacgcuuuuuuaaagagguggugucucacuguauugcccaggcuggucucgaacuccugggcucaagcaguccucccacuucagccucccaaagugcugagauuacagacaggaguuaccacaccuggcuccccuuaaguauuauggccccuugaaugcacaaugaugaacaguccugauuuugaauuccuuuaagauguauuuuauacuuuaauaugcuuaaaggugcugauuuuaaaaaggagaaugauuaugccaguuacaagaccugugauuuaauuguaugccuuuuaaucaaagguaguuaauuacuuuuccaaaaauggggaagaauaaagaaacuauucacaguuaaugguuugaaggaggaggaaaagacauugagaaauucuaagaaaaaucugaaaagcaaagugacauugaaaacaguagccagagcuggggcgcaguggcucacgccuguaauccuagcacuuugggaggccgaggcgggcagaucaugaggucaggagaucgagaccauccuggcuaacacagugaaaccccaucucuacuaaaaauacaaaaacaaaauuagccaggcgugguggcaggcaccuguagucccagcuacuugggaggcugaggcaggagaauggugugaaccugggaggcggagcuugcagugagccgagauggcaccucugagacucagucucaaaaaaaagaaaacaguagccagaaguaucaaauagggcucugucaugguuauguuuugguuauagaguuuaucucauuucagaaaguauuuuaaacuuucagaagucauggauauaaggcucagccuccauauuggaaaaagauaaagcaaacauaccagcugcccaaccuaauacaguuauuauuauaaaagaguaugaaguuggcucugaguuuuuucuggcagccggauuaaaacuaaugggccaguggcucucagucucuaaggcacuguaaggaucuggaaaaauguaaaugaaagaugaaacuggauuuuuucagagaaggucauaagugacucuaguaauagaaauuuugcuuucuuugaggcuggaaaucaauuacacauccuuuacuuaaggaauaaaugauacaaauggagaaaggaugcuacuaguaauaugagugcuaaaacaguaaauuucaguuauuagagcaguuucauauauacaacuagauuuccacauucuggguaugucucacucaaagcugccaaguaucagaauuacuggcauuggaagaauggaccgcuugccauucuuuuacuucacuggcaaaauuuaauuaaaaacuuucucuccucuuauaaaaaucugcccuagauuuacucccaucugagaguauuugcagcuucauacagaaaaaccuaaugauaauugggcuuagugugcugaaacccagaugggaauggggugagcaccuccugguccaggucagggccuugacugaacuguuaagcuucuugaaauugcuagaaugaggacuaauuucauccuguccuguuuauuggagagauccuguaagcuuagagcuucagaauugaauuccucugucuuccuuuuaaaguccaccccacaugcgagaucuaaucaaaccacaucugacuucaaagucagguucugaaauuuuucuuuagagacuuccugaagguuaaagucaucuguguucuaaucugugcccagauguggagcucugugguauuggagcuuuguccuaacuucccuuguauuauccacuugccgaagacuuagaaugagagaacucuuccugucacaucauugccccaggaugucuccuuggagaaggaguuuccacuagguaaaauaucuaacaaacguuuugccaucaucuaacaaacuuaucuaacagaaaaaaaagugcugaggggagaaaauggcaggaauugucugagguccacaaugagcaggaaauaagcagucagagugaagacacaaguuaugaggaugaucccaacucuagcaggaaacaggcucuugucuguuuuuuuccuaauuaaaucacuuuguuugccuugaguuauaggcauuucugaaaagccuaaaaaucuuaaggauagauguuuauuuucucaacuguuaauucuugauuuuucuuucuguguuuuaaaaaaguguauuuugaaccuuggagagaaaagaucuggccuuuggcuucuucaugacccaggaguagugcaaguagucaggggacuggaccagaagaccuauacagccacauauaguuugccugaggaaugaacuuucuuccaccuaaaggauagggaacagauacaaaauauuuaccucuaaguacaguuggcccucuguauccauggcuuccacauccagggauucaaccaacuauggauagaaaaaaaaauuuuuuaauugcaucuuuacuguacauguacagacuuuuuuucugucauguccuaagcaauacaguguaacaaaacaacuauauagcauuuuuaauguauuagguauuauaaguaauuuagagaugauuugaaguauacaggaggaugugcacauguuauuugcaaauacuacaccauuuuguaucagggacuugagcaucuauguauuucgguauacaagggagauccugaaaccaauuccccaugaauaccaagggaugacuauacuauaggaccuuaguaaauauuuuuuuaauagaaauuaaguuggccaggcgcaguggcucacgccuguaaucccaacacuuugggaggccaaggugggcggaucaccugaggucaggaguuugagaccagccuggcuaacauggugaaaccccgucucuacuaaaaauacaaaaauuagccgggcacagccgagcccgauggcucaagucuguaaucccagcacuuugggaggccgaggcaggcggaucaccugaggucgggaguucgagacuagccugaccaacauggagaaacccugucuacgaaaaauacaaaauuagccaagcgugguggugcaugccuguaauccuagcuacucgggaggcugaggcaagagaauugcuugaacccaggaggcgaagguugcggugagcagagaucacaccguugcacuccagccugggcaacaagagugaaacuccaucucaaaaaaaaaagcagggcgucguggcaggcgccuguaaucccagcuacuuggaaggcugaggcaggagaaucgcuugaacccaggaggcagagguugcggugagcugagaucgugccauugcacacaagccugggcaacaagagcggaacuccaucucaaaaaaaaaaaaaaaaaaaacuaagucauaagucauuucuuguuauuaccuacuucacuguucacuuggagacugcugguuagucugacuagaauuucuuuaucuggcuagaauuucuuuagccgugcccugaguacauaagaauaguuaaccggaagccauaucggaagaucauugcuucuaauaauuuacuaggaaacuuaccuugggcaagucuuuuacccccucugagccaguuuucucagcaauuaagagauagaccaucugcucucuuggagcccuuuugaacucuggaucuaaucuauagucccuuaugcuuuguuccauacugcuuaaaucagcuucucagcaucacaucucacugggggaauuuggagaacaagacggauucaugcucaaggauggaaauuuuacucuagaaaacucagauuaaccacaccgcuuauucuuuaaaguagguuggaacuguggaauaaugcugauggagaaagcaaggacgacccugacagaaucaaugcaagagaggcucauacccacuguaaagacacuagucuggcagucuccuuuuguuuucagacaaccaaaauacacaaguguucaggaguacuugucuuaagagaugaaacacuucucuuuuuagguuuuuuauuuuguuuuguuuuuguacuuggaagugaggauauuauaaccguagagaauugcuaguuuuauugcacuuuggcuguacucaucuuuaaacaaaaaauauaucucaguugacuauauaauuucauuuucuuuugguaucagagaggaucuuauuucaaacauugcauuucaugacauaucuaaaaaguuuuuuugguguucauuaacugcuccugccagaauuacuguguuuuaacuauuuuggaaauuuuccuaauauuugcuuauaacuuccagcaugguuacuguguuuguggcauauguaaucaauaaauuguaaucauuauaaagcaccauaaauaauuuguuuuauuuuguggucauccguauauuaagaaaacugaaccuauucuaauuuuuccccuuuucuaccucccccucaacaguaaaaagaacauaagaaagcagcgaaugaaaaucuuauucaauguuguucuugaagcucgagagccagguucaggcagaagacuuugugaccuauuuaugguuaaaccauccaaaaaggacuauccugauuauuauaaaaucaucuuggagccaauggacuugaaaauaauugagcauaacauccgcaaugacaaauaugcuggugaagagggaaugauagaagacaugaagcugauguuccggaaugccaggcacuauaaugaggagggcucccagguaaggagggccagcgguccugaaguaggcacauuuugcgggagagggguacuuauagaauaaugcauuuugagagaccagcucuagaggcuuaacuuagauuauucuuuuuggugacuagguuaauugauuuuucuucauuguuuacaaucagaggcaguacauuauaaagauaaacguuccuacuuuguaaucugacauccuagauuugaauuuugcucugccagucccuguguaaguaauuuauccuuccugagccucaauuucuucaucuauaaauuagggcuaauaauaguacuugcaucaggguuguuguaggauuuaaaagagauaauguauacugagcauuuagcagagugccugguacugaauaagcacucaaaggaaagccaauaguauuaaaaucuuucaucaucaucauuacuacgauccucaacgaccauacuucuccaaagacagccuauauagaaaauguauaauuauauaaaaaucagcaugauagucccauaaauguaccucuaaauaauuuauuuaauugauuuugcuacagagcaucuugauuuuuuuuugagacggagucucgcucugucgcccaggcuggagugcaguggcgccaucucagcucacugcaagcuccgccucccggguucaugccauucuccugccucagccucccgaguagcugggacuacaggugcccaccaccacgcccagcuaauuuuuuguacuuuuaguagagaugggguuucaccauguuagccaggauggucuugaucuccugacgucgugaucccccugccucagccucccaaaguucugggauuacaggcgugagccacugcgccuggccaaagcuucuugauuuuuaguucuuuaucguuguaacugagauacagucucccuucuuugaaacuuuuucuauuugauaucuuuuuauccacuuuacaucucccagaaauaaaauaacauuuuuaagucauuuguuucccucugcaauuacauuugauuauaaaauaaaguaugcauugaggaugcuuauagauaaaaaaaugguucuaucuuaaggguuuacacaguccucagugucauuggcuaauguaccccuugucuaucacugguagaggaaaaagccaccuuuaagagagguggccagacaagggaggucacuuauucccucagcuccucugcuuugguggguggccaagggaggacauagcaucugcugaggagguaagaggaggggcuguggaugcaaagcauaaggugaguaaccuuauucuugacuacauauuaccacccuuggcucaguccucagagagagaucccuaagcaaggauaauuguuuuuuuauagauuaagcuucagacugugaacucagauuuggaauuuaagauauugagauauugcucuccaacuaucagauauuuuuaguuucuaauuucuauugggcuaagucugcuaccuugagcguccaguggagaagaaagguuuuugaagaaaacaacacauguaaauguguuucaggacuuuuguuaaaaccugcagugauucuacuacagugguucucaaacauuaacaugcaugucugugcauuagaaucaccugggaagcuuaaaaacaaaccaguuaaggccuaggcucucccacagauagagugauuuuauugcucuguagugaggcugguuuugguuuucuuuaagcucccaacuaucauaaacugucuuuuuaaaacuucuuuauggaugcauuuuauaccuuaaugaaaaguuuuuagaaaauaauugaaguauauuuuuggaauguagguuuauaaugaugcacauauccuggagaaguuacucaaggagaaaaggaaagagcugggcccacugccugaugaugaugacauggcuucucccaaacucaagcugaguaaggcagccucacacuucauuauuuaguuuagucuaucaagaagagauugcugauuuuucugaaauaauauuuaauuaaauuaugaauauauuugaacucacuguacuccagcauggaguucuuuguucuugucaagcccucucauuuacuguauuuuaaguagcuaaacugugacaagcauauggggaguaaaauauaaugucagagguuuuguuuacuuucuuaaaugcguagacauuuuguaaauuuuaaauaguaagaauagauuuuucuguacguauaaugcuguaagaauauaguagcagauuuuuuuuuccuugguauguaugucugacaauuacuagaauuaaaaaugaaucccagcaguuccaacuggacagaauuugaggaguuagagauguccagccacuguacuauacucagcuaucauuugaguguagucugugguugguuguuuuauuaaaaguuguaagugaaggccaggaacagugacucaugccuguaaucccaacacuuugagaggcugaggugggcagaucacuugaggucaggaguucaggaccagcccggccaacauggugaauccccaucuuuacuaaaaauacaaaaauuagccggacauggggguacaugccuguaaucccagcuccuugggagacuaagucaggagaauugcuugaaccugggaggcggagguugcagugagccaagaucacaccacuguacuucagccugggcgacagagugagacucugccucggaaaaaaaaaaaaaaagggaagaaaaagguuggaagagaagacaggaaaaguuauuaauaccauuagauaagagauuucugucuucuuuaaaaugauguaaauaaaauagauaccaagcaauugauaaugauacucauuggagccauguuugcugaaaagggggaaaacagacagacuagcuuuuuugcuuuuuuuuuuuuuuuuuuuuuuuuugaugaagcaucucgcccugucaccccgguuggagugcaguggugugaucuuggcucacugcaaccucugccucccagguucaagugauccuuccacucagccucccacauagaugggacuacagauguacgccaccaggcccagccaguuuuuuguauuuuuaguagagaugggguuucaccauguuggccaggcugcugucaaaacuccugaccucaagugauuugccugccuuggccucccaaagugcugggauuacgggugugagccaccccgccuggcccagacuagcuuucuuaucugaaauuacuaucaacuaaauuugauaguagauuuggguaugauuuacugcuaagcgaugaauccuuuuuaaggcauuugucuuuucauggaauuguaaaagcauacagaagguuugcagaaauguaaaacuuucauuccacuuuguaggaacacaguaacuuuuaaaguucaggaaaaaggggcuuuuuaugugggauguuaauuuccuuuuuauuucuuuuguuuguuuguuuguuuuaaauuaauagaggcagggucucccuguauuggccaggcuggucuugaacuccugggcucaagcgacccuccugccucugccuucuaaaguguugggauuacaggcaugagccauggugccuggccuccuuuuuauuucucuguguuuuuuaaugaaaaauaucaaaaauauauaaauggaaaguacaguggccagggguggugacucgcuccuguaauuccagugcguucggaggccaaggcaggaggaucacuucagcccaggaguuugagaccagccugggcaacauagggagaccuugucucuacaaaaaaauauaaaaaauuagccaggcgugguggcacaugcauguaccugugguccuagcuauuugggaggcugagguggaaggauugcuugagcccacgaggucaaggcugcagugaacccugaucaugcccacugcacuccagcaugggcaacagagcuagacccugccuccaaaaaaaaaaaaaacagaauaguccagugaaccccuguauauacuuguuacccaucauuugucaaaaucguggcaaacuuauuuccuauccccuuuuucuucuucuuuuccuaaauuauuuuaaaacaaauccaaucaugucauuucacuuccacauaguucaguaugcaucuguaauaugugcagauaucugccacuuugucuuugaggauaaaacaaauaaaaauaaaauaaaauaugcagacauuuucauaaauaacaaugaaguaauuaucauaccuaacaaaauuagcaguaauuucuugguuucaucuaauacuugauaaauuaucaaguucuucugauugucucacaaauguauuuuuauaguugauuuccucaaaucagacucucauuaaguucuauauaauaaauuugauuauuauacucuuuuuuuuuuuuuuuuugagacggauucucacucuguugcccaggcuggagugcaguggcacgaucucggcucacuacagacuccgucuccuggguucccccaauucuucugccucagccugcaggguagcuguaacuacagggacacgccaccaugccuagcuaauuuuuuuguauuuuuaauagagacagggcuucaccauguuggccagacuggucucgaucuccugaccucaagugauccguccgccuccgccucccaaagugcuaggauuacaggcaugagccaccgcacccagcagauuguuauacucuuaaacccaugaucuagagcagucuccuuccuuuucuuuccacaugccaguaacucauugaagaaaucaggucacuuuccuguacagugucccaaguucuagguuagacaggcuugcuuccuugugauaucuguaacuuuuuucuuuauuucccuuauuucuuauaaauagaaguuaacuuugaaggugcgauuagauuaaguuucaccuugguggugauacuuuauaagggguuugcugcccuuauguuguaucaugucuugaggcagugucugguuaaaguagaauccagauaaaguccacauacugcaacugauugauaccucuuuuuuuuuuuuuuuuuuuuuuuugagacggaaucucgcucuguugccuaggcuggagucaguggcacgaucucggcucacugcaaccuccgccuccuggguucaagugauuguccugccucagccucccaaguagcugggacuacaggugugcaccaccacgcccggcugauuuuuguguauuuuuaguagaggcaggguuucaccauauuggccaggcuggucuugaacuccuaaccucgugaucugcccgccucggccucccaaagugcugggauuaaaggugugagccaccaugcccagcccgauacuucuuuuaaucuguaaacuccccuccagcucucucuuuuuccaccccuuaccauuuaucuguugaagaaauuagauuugugcuguaguuucccauagucuggguuuugcugauugcauccauauguugugggguuuuuuguguguuuuguguuuuguuuuguuuuguggagacagggucuuacucugucacccaggcuggaguguaguggcacauuuuuggcucauugccaccuccaccucccuucugaagcaguccuuccacuuuagccucucggguagcugggacuacagguacacgccaccacguccagcucauuuuuuuguauuuuuaguagagacaggguuuugcuauguugccaggcuggucuugaacuccugggcucaagugaucugcccaccuuggccucccauaguacuaguauugcaggcaugagccacagcuccuggcccacuauguuguacuuucauguguuccucuguccuuuguauuuccuauaaauugguaguuggagccagaggcuugaucagauugaggucugauccccuguucucucccuuaggcagaaaaaccgacuucauagguaauauauggucuuccaucagguacaugugaaaucuauuuauggcuuucuguuaacagguguuguugcauacuucauuaauuauuaauucaugaaagggauguaaaauugugauaguuuuuaauuuuauuccuuauuagcuauagagaaacuuugccuuaucuaauauuugauuagccagugguacaguguuuuuuuugugugugucuugcuuuuugaaaggauaaaggcuugauuuuuguuuuauuuuguuuucaccuuuaccaguuuucaaaauauguauugguuuacuaacauccuucaauauuuacccauuuuguuguuuguuuguacguauuauuaagaacuaccagacuuaaacauauggcugaguuguaauugaaguuauuguccuuauugauacucaggcugguucaggcucguuccuguauucuuuuuguuuuguuuuuuugagacagagucucgcucugucgcccaggcuagaguguaauggcuugaucucagcucacugcaaccucuaccuccuggguucaagcaauuauccugccucagccucccgaguaacugggauuacaggcgccaccaccacacucggcuaauuuuuuguauuuuuaauggacacaggguuucgccauguuggccagguugaucuugaacuccugaccucaggugauccacccaccuuggccucccaaaguguugggauuacaggcaugagccaccacgcccagccgguuccuauauucuauugacaugaagucaugguaagaagucauugauagauucuuuacugucuaguguuugaagauauaccagacugggaaucagccauuuaccaaggagcccuaccuuuuucauguuucugcugaaaggugagggcuccucaacauuacuauuuggaauuaguauuuuaaaacucuaaugugggcuauacugcuacugagguagucauuguuuguacgauuuucaguggacagagcuaggaaauuuguguguuuguuuguauguuuauauuuaaagauaaauuacaucauaaguucauagugauacuuucaauugagauuaaaggccucaagguaauuauuaauguccuacguuuuaacauccguuaucucuuuuuaucccaugaugaaaaucucaguucuccaggauaccagaggugauagaaugucacauagcuacucauuugcuuuauuccuucuuauucacagcuuucucaaccuuacaguagucucccaucaaaaauauaauuacugaaaacaguuaaaaaaaauuuuuaguacuuuuuugucugcagguuauauuucacuauagacaugcuaauugcuagauuuuacaaauuacuuggaaucgucccuugugguuaugcuaccaucuguauacaaauuuagguucauuuauuuuauucauuuaacauuaaauaucucucuuuagguaggaagaguggcauuucuccuaaaaaaucaaaauacaugacuccaaugcagcagaaacuaaaugaggucuaugaagcuguaaagaacuauacugauaagaggggucgccgccucagugccauauuucugaggcuucccucuagaucugaguugccugacuacuaucugacuauuaaaaagcccauggacauggaaaaaauucgaagucacaugauggccaacaaguaccaagauauugacucuaugguugaggacuuugucaugauguuuaauaaugccuguacauacaaugagccggagucuuugaucuacaaagaugcucuuguucuacacaaaguccugcuugaaacacgcagagaccuggagggagaugaggacucucaugucccaaaugugacuuugcugauucaagagcuuauccacaaucuuuuugugucagucaugagucaucaggaugaugagggaagaugcuacagcgauucuuuagcagaaauuccugcuguggaucccaacuuuccuaacaaaccaccccuuacauuugacauaauuaggaagaauguugaaaauaaucgcuaccgucggcuugauuuauuucaagagcauauguuugaaguauuggaacgagcaagaaggaugaaucgguauguuuucaaagccauuuuuauuuugaggauaugugcuauuuaauacaaaacagaugaaagaauauugcuuugauguacuauuuccacuuacauacaugauuuguaguugguagcaugcuauucugaauucuaaucagccagaacuucuuaagagugaguauauucugugggggagagaaggcacaccacuaagucaucuaguuuaaggccagugaggaggaagacaaaauugaaaaucucuugaaaagcauaaacuuaaaauacagccuuucauagaauguguuuuuuaaaaagauaaauguuucuaauuggaaauaguaacagcguuuuucuuuuaagguuuggcuucagugcacgaaugcuuuaaauaaaauagcucuaagguguuguccugagguuagacugauagaaauuugaucaccauuuuaaguaccucagaggguuucuuuuuuuuuuuuaaucucagguuucucaccuuaagagcuugcugaagacauuaaauguucuaaaagaagcaaucaaauuuagauuuacuuuaaacuuaaauuuccuucuaauuuuuaucugugauauaucguugcuacaugucaauagcagacuugacuauuaaauucagcaauuacaguguauuuuauaugugcacuuagagacaguuggaaaaauauaaaaaaaaaaaagauacaaaccuuaccuuccuggagcuuacagccuaucauguuuagaacuagaccuucaggcaguguaaugccagcuggggaaucuaugaaaucagaauuugcucugaaccuuuaaagaaaagcaaguaguaauguuugcuuucagugucuuugcaaauaaaagaaaaaaaacauaguaacauuugcugcuuguguuaagcaccagcucuucguaaagcaccaugcuaagcacuuuaugaaggcaaucucuaacccuuaugauagccauucuagauaagugauaaucuuuucaguuugcaugugaaagaauuagaggcauaggcagagaaaaguuacccauagucuuacaacuaguaaaugaugugacuugucuugcucuccacugcagagggcuacuccugagccaguuaccaggacaagucauggagcacggccauagaugauaagccuugagcucugugcucuaaaagcuugaagucugauggaugggccaggacuuacgcuuaagggaaaaauaauuccacacaugagacaacaugccacaaccuuauauuuaguaaagauggugauguaaggaacucugugggccacaguucuccuuaaaaggcaugggaugauagguaggguucaaaugaauaggccagaggauauuucaaauaagaugaauguuaugagcaaagaaauggaguuaggaaaugaauaugauauguuuaagagacagggauagaguuggggccaguuuggugaggcccaugugugacacuuuuaagaaaugguccuuaauaauaugguucuucagcaauugaguagaaauaaagagaaggauggagggacaucuugcagucaaaaacucuuggaguuacucauuuauucaacacauauuuauugagaggcuacuuaaugagcauauucuagaugcauguaauacaccagugggcaaaacaaacucugcuuucauguagcuuagacuucuuucuguucuuguucuuggcuuaaguaguccuuaagucuaauaccccucccuuccucuccucccugcuuagccccauuacaucuugguguuaguucugugagucuuucaaugaguauuugucuucuagauuauuaggaacuucguuuaugucuuauagaugaaauguuuauuuuaagaauuaagauuuguaucucuaggaaauuagcucuuuucauucucccauuguugacaugguuguuuuuugcuuuugaggccuggaagauagaguccaagguguauuuuuaugagauagugaugcacacaguuuuacccucaugcccagagcuuuguugaaaaacaaaagggaucccugguaauuuaguaguuaggaaaaauuuuuuaaagaaaaacauacggggagccauucuuaacuuugugaacaaagauaguauugugauugcuuauaguacuuauuaagaauaaguacuuaauaagaauugauggagaugcaucaauuuagugaaugauaaacuaugccuuuaucuacuauauuaucaguaacaaagcuaggcaucccagaaauauuaguucauaaauucaaugaagucuacauaccguagauuuccauguugaucucuaagagucuucaugcuucaucaccauuuaccccuaccccuacccaccacugcuacccaacaucaccuaggacuucacaggcuaaaauagaaggaaucugaacagugagacguaacaagagaaaaauucacucaggugacaauaguuuguccaucaacaguauuuaguaacagcacagugcugacucaugccaguuggcugcuggcuuuccuaaacugcuggcaguauucccagacuaaacacucugauccccuugcagguaaaagagaccugugggaagaugaacaagggaagcauuaagagccuccuguauucuuaauuauuuccuuuugcugaaugucugccuuauauaaaaagauuaccaauugaggggaauuuagaguucuuuuuccagcuugcguuuauguuccugcacauucaaugaauaccugaccucguagacuaauaaauucuuuauaaugcuuugaauaaacaaaagcauauacuagguguuuagugacucuuguacagaauguucauuucuaaaccaugcgauaugauggaauuaugaucugcccuuuuaguauaccaugaaagguauuuacaaaaauuuuacaaaaauuuuuuacuuuuaauuuacagaaauuuucacuuuuuauacuuaaaauuguacacuauuauaaaaugaacuuuaauuucaagugaacagaauucaaauaucuucauucagaaaacaaacauaaaauuauguuuuaggggccagguacaguggcucacaccuguaaucccagcacuuuuggagcccaaggugggaggauggcuugcacucaggagcuugagaccagucuggacaauauagcaagaccuuccuuagcucuacuuaaaauaaaauuuaaaaaaucagccaagcuuggugacauaugccuauagucccagcuacucgagagguugaggugggaggauugcuugagccaggagauugagacuguagugagccaugaucgugccacuguacuccagccugggcagcagagugagacugugucucaagaagaaaaaaaaaguguuucaggggugucuucccuugguaaguuuuauuuuuauugcuuuccuacaaguauuagcauuucuaugaccccaaaagauauuuaaaaccuuuccaaggccggacacaguggcucacaccuguaaucccagcacuuugggaggccacggcgggcggaucaccugaggucaggaguucgagaccagccuggccaacauggugaagccucguuucuacuaaaaguacaaaaauuagccaggcauggugguaggugccuauaaucccagcuacuugagaggcugaggcaggagaaucgcuugaaccugggaggcagagguugcaaugagcugagaccgcaccacuguacuccagccugggcaacaagaacgaaacuccaucucaaaaaaaaaaaaaaaagagacuuuccggaaacacccauuuagauuauugaucgugucuuuuaauuguuugucaguucaccuuugcugaugggagcagcauucuggggaccucucugaaguuugaugcucuaguggcauguaucaguagguggccuacuuggccacacuccucugaccagaaugucucuguaacugcuaagaccuuugugguuaguuuugugaauaaguuuuuagacucugguauucuuaguuaauagaauuugauuuaugccagccaggugugguggcucacaucuguaauuuaagcacuuuggaaggcugaagagggaggaucacucgaggccaggaguucgagaccagccugggcaacacagggagcacccuguugcuacaaaaaauuuuaaaauuagccagccugagcccaagaaguugaggcuauggugagcugugaucacgccacugcacuccagucugggugacagggcaagacccagccucaaaauaaaaugaaauaaaaacaauuguauguaaaccuuccucagaccacagugguacuagaaacaguaauaaaauuuccuccagucaaaauucuaaagucugaaguuuauuuugcccacuccccacauuuuauuuauuuauuuauuuauuuauuuauuuauuuugggacagagucucacucacucuguugcccagacuagagugcagcggcgcgaucuuggcucacugcaaccuccaccucccggguucaagugauuguccugccucagccuccugaguagcugagauuacaugugugcaccaucaguuuuuguauuuucagcagagacuggguuucaccauuuuggcccaccuuggccucccaaagugcugggauuguaggugugagccaccacaacuggccuguuuauugauuuuuuuuuuuuuaacagacagggucuugcucuguugcccagagugggaaugcagcggugccaucauaacuuacugcacccuugaacuccugggcucaagugacccucccgccucagcuucccggauagcuaggacugcaaguguguaccccaaugccaggcuacuuuuuuguugagacagcgucuugcuguguugcuuaggcuggucucaaacuccuggccuuaagcaguccucccgccucggccucccaaagcauugggauuauaggcaugagccaccaugccuggccgcuuuauuucauaaaugaggaaggagacucagaaaaguucuggguaugacauacauaaucuuuuuuccaucuuucacuauguugccuuugcugguuccccagaauuacacaguuauuucugggaaacuaaaaugaacauuaacucugaggccuguaaccauuauagaauacuuucauggcuuugcuuuagguuccgauauucacagggucucacuagccuaggcaaccaugauguaggaccaaaaggaagaaaauagagccuauuauguaacacaucggucugcuauuaagagaaaguaaaaauucaaagaauagauacgaguaaguguugaacauauuguggagccuugguacaauucuugguucuggcagccaccuuccccugccagaaucgauugaugcgugugccauauaucuccaagagaaaauacaugaggccuuucguuuuucaugagcuguacaagaagugagccuugaaguaaaggaaaauggugggcauggggcuuaccaugguaaaaugacacuuuggauuuuguucuaacaaacuucggaaagauacucuucauagaccuguacagaaauaccacuauaucaauuaaagaagcauuuaauagaauuuaacauauaauugagguguuuaaaagaaacagcuuguaugucaauggauacucuugaugcuguuauaggacagauucagaaauauaugaagaugcaguagaacuucagcaguuuuuuauuaaaauucgugaugaacucugcaaaaauggagagauucuucuuucaccggcacucagcuauaccacaaaacauuugcauaaugauguggagaaagagagaaaggaaaaauugccaaaagaaauagaggaagauaaacuaaaacgagaagaagaaaaaagagguugguuucuuuucauuuuauugaauaugaaaaaaugcacugucuucuagguguucucauaauuagcuguggaaaagaguccuguuuguaugaaugaaaacucaggguauugacuauauuagaguagacgcaaugagauggaaauauuuuuauaguuaucaauuuggucaucagaccugggaaagauuaaaaguuaccugugacacagcuguuauccuagcauuccaggaaaagagucaguuaauucacaagugugggggcuuaaugccucuuuauauuauugguagaucaaaaccuaagcaggccagcuagaacuagaaagcauucucaacagugaguccaugaaguuuuugccacaucaugcaguagcauugcuuuccucauagauacuuuggaccagacaaguagaugauauuuugguugaaucacauaccuggagaaaaguuuuauuuuaauuguaucaaacuauaaaauguuacuuugggucacuugccagaauuuagaaauauuuugauaacaggaccuuaugauuacaaauuggaucauuucuguuaaaguucaaguucacauagauuccuagaaugugugacucuaaguuauguuaaucuuuggcaucaaaucuccuccguagauuuuuuucccuuaggcaagaaaacaaaauagauugauuugaagcaaauucuuauaagcgauggcaaaccccaaaaagaagggaaagagacuugguuggugagaauaguaauuuugccagcauagaacuaacugcaaaaccaacagcuuugucaccaaaggagauauaugauauacucauucaggaagauagugaauauauaugugugggguuuaggggagaggggaaucuaugacuuugccagcuaaaagugguugaugcagaaaugcauggaguaaagcugcaacuuugauggcccaaggugacgauccaaguuaaagaauauucugaaaauuagacaucuauaaaaggacugagauaagcucuccacacauucccagccagcuggaaaaccuacacaugcugugggggaagaugcaaaagaaccuggugaagagcagaauccaaaggauacuugaaaauuggcugcaacuuugagugcaucccccaaccuauacacagaucugucagcacaugguacauccuuacgggcuugagguaguuaaguacaaacuucaccuaagucauuggcuauagaaagagaggagcaaccccuagugucagguuuccuugcagaccuauagugggagcuccagaggagagaagagaaagggagagaaaaaagauuugaagacauaaugcugaaaaccucucaaauugaugaaaaacagcuccaagaauuucaaguaagauaaucacaaagagagccccauuuagauacaucaucaucaaaccgaugaaaaucuuaaaagcagcaacugauugaucacguacauguaauuaucugcacauuccauccaggggccuggggauuguccagcccaauugacaauuagugauaccugagcacuuuucccagcauguggggucagggccacucaaucugucacuaccacgacaacuggcacccaucuucauguguuaccugucgguccggguacuagcucaccuaucauagccauugccagcacuggugcagaacacuugggucccagagaguuggcccagcacugcuacugcuuucacccuugccacauccacugcccaagggcucgggaacccacccaccugcucgauccacugcugccauuccuggcacuccagcaagccagcuggagucccaggaauuggccugccuggaccugcuaacaccagugccaguauacaccacucuggggcccaaagcauggcccccuugacagcccaguccccagcaguacuuuaugcaccucaagccaggcacccccaccuccuccccaccccccacauuacuuaggaacugggcuccacaggagccggugaguggcaggcaagcaaacauuacccccugagcuccgcuuccuguuagaucagugguggcauuagauucucauaggagcaugaacccuauuguggacuguguaugugagggaucuagguugugcacugcuuaugaaacucuuaaugccugaugaucugagauggaacaguuucauccugaaaccaucccacccaacccucaucucuuacccacacaaaccccaucccugucuguggaaaaauuaucuuccacgaaacuggucccuggugccaaaaacguugggggcugccgcccuaagccacugaggaagucauggauaccacugauacuguuuacaguagaaggaaucauacagagauuacacuacuguacaaacccagauucaaaaccaaaguauccugcccaacgaacaccacagauacaucuucagggagaaguccucuucuacgaaaguaaauucagaacacuggaagaagugacuguuguacuagacacacauauaauaucaauguaaguaaggacacaggaaucaagaaaaagcaaggaaauaauuacaccuccaaaagaacccaguaauucucuagcaauagauuucagucgauaaguaauuuagcggcugggcacgguggcucaugacuguaaucccagcacuuugggagaccaaggccagcagaucaugaggucaggaguucaagaccagccuggccaacauggugaaacccugucucuacuaaaaauacaaaaauuagccaggcgugguggcgcgugccuguaaucccaacuacucggaaggcugaggcagaagaauaccuuuaacccaggaggugaagguuguagugagcuaagaucgcgccauugcacuccagccugggacagagcaagacuccgucucaaaaacaaaguaauuuaucagauuccaggaaaauaauucaaaguuugauacaagauaauucuuagaaacauuacaaagaaaucagaaaaacaauucaggauaugaaugagaacuuuaucaaauagacaucaugaaaaagaacuaaaaaauucuggaacugaagaauuuauugaaugaaauacaaaagauauuugaaaacuuuaagaacagacuauaucaagcagaaaaaauaauuucaggaauugaugacaggucuuuugaaauaguaauaacucagucaaagaaaaauaaaaaagaaugagcaaagcuugguaacauaagggacaccauaaagugaccagauucucaaauuuucaguauuccugaaggugaagaggaaauuuuaaaagguugaaaaaccuauuuagugaaauaauggaugaaaacuuuccaaguguaucaagaaauuuagacauccaguuacagaggagucaaagauccccaaauagauaaaaagagagaacuuaaaauguucccaacacauagaaaggaugguuaccccaaauacccugacuugaucauuacacauucuauaaaugcaacgaagugucacaugugccccauaaauauuuauauuauauaucaaugaaaaacaaaaauugugauuguaauuaauaucacugaaaugcacacuuuacauugguuuaaaaggcagauuuuguuauagauuuuuuaucacaauuuuaaaauguauuuaaaaauaauacauccaugaaauguuaauguuuuuauaaaaaauauuuucauaugcaagugagauugacaguaaaaaaaaauuuuuuuuuuuuuugagauggagucucacucuguugcccaggcuggagugcaguggcgugaucucaguucacugcaagcuccaccucccggguucacaccauucucuugccucagccucccaaguaguugggauuacaggcgcgcccaucaccacgcuugguuaauuuuuuucuuuuuuuuuuuuuuuguauuuuuaguagagacggggugucacuguguuagccaggauggucucgaucuccugaccucaugauccgcccgccucggcuguccaaagugcugggauuacaggcaugagccaccacgccuggccaacaguaaaaauuuuuuuaaaauuugauuugcauuucccugaaguuuauaguuauguugagcauuuuaucauaugccuauugaccaucuauauguuuauaguuagauaggaaggauaaguuacuaguguucaauaguacuauagacugacuauaauuaacaauucauuuuauauuuucaaauagcuggaagaauggauuuugagucuucucaacauaaagaagugauaaauccuugagaguauuaauaugcuaauuacccugauuugauuguuauacguuguauccauguuaucgaaauaucacacuguacuccauaaauaugugcaauuuuuuuugugugugaugggcucucauucugucacccaggcuagagugcaguggcacgaucauggcucacuacacccucaaccuccugagcucaagcgagucucuugccucagucuccugaguaguugagacuagaggcaugugccacaccugccuaauuuuuuuuuuuuuuuuuuuuuuuuugagauaucuggcacuguugcugaggcuggagugcaguggugugaucucagcucacugcagccucugccucccagguuccagcgauucuccugccucagccuccugaguagcugggauuacaggcgugcgccaccacacccagcugauuuuuguauuuuuaguagagacggggcuucaccauguuggccaggcuggucucuuaacuccugacaucaggucaucugccugcuuccgccucccaaagugcuaggauuacaggcgugagccacugcaccuggccuaauuuuuuaaauuacuuguagagaugagaucuugcuguguugcccaggcugguuucaaacuccugggcucaagggauccccccuccugagauucccaaagugcugggauugcagacaccagccacaugauuaucauaugucaaugaaaaauaacaaaagcccaaaaagugguauauucauccaaugggauauuauuccaccauaaaaaggaaugacauccuuauucaugcuauguaaaugaacauugaaaaccuuaugauaagugaaguaagccaaacugaaaaggacagauauuguaugauuauacuuuuuugaaguauauagaauuggcaaauucauagggacagaaaguggaauagagguugcuaggggccagguugcagaguggagaaauggauaauuauuguuuaaugauuaaaguuucuguuugggauaaugaaaaaguuuuggaaauaguuugugguuaugguugcacaacacuaaguuauugccacugaaugguacacuuaaaaguggucagaaugauaacuguuuuguauuauauguuuuacuacaauuauuaaaaaacuaauaauguaauauaccaaaaaccauugaacuuuaaauaggugaauuauguggugugugaaucauauaugaaguuguuuuccauucagagaaauauuagaauacaaaguugaagaagucucccagaaguagaacaacaacagaaauaaaggaagaaaaagauaauuggcagggugcaguggcucacgccuguaaucccagcacuuuggaaggcuaaaguggguagaucaccugaggucaggaguucgagaccagccugaccaacauggugaaacccugucucgacuaaaaauacaaaaauuagccggguguggugguacaugccuauagucccagcuacucgggaggcugaggcaagagaauugcuugaaccugggaggcagagguugcagugagccgagauugugcuacugcacuccagccugggcgacacagugagacucucccgaguagcuggaacuacaggcaugugccaccacacgaggcuaagaugggaggaucgcuggaucacuugagcccaggaguucaggguuguagugagcugugauggugccaguacccugaaaccugagugaacccugucuguaaaaaaacaaaaaaaaauucuagucucucugucccuuugaguaaacugauaguguuacugcugguauaaaauucucaagaaccuuauagaucugcuguguauuacacagggauucacuugauuaaucaauugcuagauaacaguuuucaccaaaauuggcagaacuuuuaaaaauuacauaucuaauaccaagaaauaggagaauuaggagacagagcaagauggccgaauagaagccuccaccaauuguccuccccacaggaacaccaaauuuaacaacuaucuacacacagaaagugcaccuucauaagaaccaaaaaucagguaaacaaucacaguaccuaguuuuaacuucauaucucugaaagaggguagaaaacacagucuugaauugcuggcaccacccuucucccauaccccagcaucagcugugugacacagagaaucuuugugcuugcgggaguuagagcacagugauugagggauuugcauuggaacucagccgaugcccacagaggaaacauucaggccagcccucaucagaggggaauuguccagcccaguggacuggacaauugucagaacuuggguuccagcaagccuugccacugugugcuaaagggcucugggguccuaaauaaacuugaagggaaguguaggccacaaggacuacaacuauuaggcaaguccuagugcugugcugggcucagagccaguggacuuagggggcacaugacaugugagacaccagcaggguaaccaggggaguacuugcgccaccccuccccaacccugggcagcuccgaaaaagucaucuuccuccacuugaggagaggagagggaagaguaaagaggucuuugccuugcagcuuagauaccagcucagccacaguaggauaaggcacugggcaguccugaggcacccauuccaggcccuagcucccaugcagcauuucuagacaugccccugagccagaagggaacacgcugccuugaagagagggacccagucuugguagaauucaucaccugcugacuaaagagcccuugggcccugaauaaucagcaacaguagccagguaguaggccuguaggauacauuucuuuuuuuuuuuuuuuuuuuuuuuuuuuuuuuuuuuuuuuuuuuugagacggagucucacucugucgccaggcuggagugcaguggcacaaucucgacucacugcaaccuccgccuccuggguucaagcaauucuccugccucagccccccgaguagcugggacuacaggcgcgcaccaccaaacccagcuaauuuuuauauuuuuaguagagacgggguuucaccauguuggccaggauggucuugaucucuugaccucgugauccacccgccucggccucccaaagugcugggauuacaggcgugagccaccgcgcccagccacaauccuacaauuuauauggaaccauaaaagacucagaauagcuaaaguuauuuugagccaaaagaaaacuggaggaaucacguuacccgacuucaauuuauauuauagagcuauauaguaucugaaacagcauggugcuggcauaaaaacagacaaauauaccaauggaaaagaguagagaacccagaaacaaauccauacgucuacagugaacucauuuuugacaacagugccaagaauauacauuggggaaaggacagucucuucaauaaacggugcugggaaaacuggauaucaguauacagaauaaugaaauuagccccgucucuugccauguacaaaaaucaaaauggauuaaagacuuaaaucuaauaccugaaacuaugaaacuacuggaauaaaacuggacuaggcaaaaauuucuugaguaauuccccacaggcacaggcaaccaaagcaaaaguagauaaaugggauuacaucaaguuaaaaagccucugcacagcagaggaaacaaagugaggggacaacccacagagugggaaaaaacuaucugcaaacuaaccaucucacaauggauuaguuaccagaauguaugaggaacucaacuccuuaagagaaaaucuaauaauccaauuaaaaagugggcgaaagaccugaauauacauuucccaaaaggagacauacaaauggcagacagguauaugaaaaggugcucaacaucacugaucaucagaacaaacaaugagauaucauaucacuccaguuaaaauggcuuuuauccaaaagccagggccugauacuaguaccccagaguuggggcacacaguccaggaguccugagcugagccuuggcccccuaaaauccucuagaaacuaagcccaucaacugaacccaucuuauaccacaaucaaacacccaaggucaucaaauaggauaaaagaaugaaaaaaaaaauagccaaaggacagcaacuuuaaagauugaaggaacuuuagcccacaaagaugagaaagaaccagcacaagaacucugacaauucagaagccagagugccuucuuuccuccaacauugcaauucaggaaacucagagaauccccacaaaauacuucacaagaucaucuccaagacacacaaucacuagauucuccaaggucaaaaugaaagaaaaaaaugacaggucaccuucaaagggaagcccagaagacugacugugcaccugucagcacaaacgcugcaagccaagaagagauugggggccuauauucaacauucuuaaggaaaagaaauuccaaccaguaauuucuguccggccaaaccaagcuucauaagcaaaggagaaauagaguccuuuuuccucaagcagaugcugagggaauuuguuaccaccagaccugccuuacaguagcucccaaaagaagcacuaaauaugaaaaggaaagacuguuaccagacacuacaaaaacacacugaaguauauagaccaaugacacaacacaaacaagauugcuuccagcuaacaacacaaugacaagaucagauccauacauaucaauacugaccuugaauguaaaugggcuaaauacuccaauuaaaagaaacaagaguggcaagcuggauaaauaagcaaggucuaaugggaugcugucuucaagagacccaucucucaucccaugagacccauaaugacacccauaagcucaaaauaaagacauggagaaaaaucuaccaagcaaauggaaaacagaaaaaagcaaggguuguaaucucauuucagacaaaacagacuuuaaaccaacaaagaccaaaaaagacaaagaagggcacuacauaaugguaaaggguucauuucaacaagaagacuuauccuaaauaauauaugcacacaauacaggagcacccagacucauaaagcaaguucuuagagaccuucagagaggcuuacacucccacacaauaaaaaaagaaaaaggccuggguauaguggcucaugccuguaaucccaacacugugggaggccaagacaggaggauugcuugagccuaggccuucaagagcagccuggguaacacagcaggaccucaccucaucucuuaaaacucccacacaauacggggagacuuuaauacccaacugacgguacuagacagaccaucagagcagaaaauuaacaaugauauuccggaccugaacacaacacugggccaaauguaccugauagacaucuagagaacucuccacccaaagaucaacagaauaugcauucuucucauuaccacaugggacauacucuaauaucaaccacacaauuggacauaaaacaauccucagaaaaugcaaaagaaggaaaauuauaccaaccacucucuuagaccacagcacaauaaaaauagaaaucaagacaaaaucacucaaaaccauacaauuauauggaaauuaaccaaccuacuccuggaugacuuuuggguaaauaaugaaauuaagguagauaucaagaaguucuuugaaacgaacaaaaacaaagacacaacauaccagaaucucugggacacagcuaaggcaguguuaagagggaaauuuaucacacuaaacacccacaucaaaaagauaggucaauggccaggcacgguggcucaugccuauaauccaagcauuuugggaggccaaggagaguggauugcuucaggcuagcaguuugagaccacccuagccaacauggcaaaaccucuucucuacuaaaaaugcaaaauuuagcuggguauggcagugugugccuguagucccagcuauucggaaggcugaggcacaaggagguggagguggcagugagccaagauugugccacugcacugcagccugggugacagagcaagacucuuguuuaaaaaaaaaaagaaagaucucaaauuaacaaccuaacuucauaggagaaagaacuagaaaagcaagagcaaaccauucccaaagcuagcagaaaaaaagaaauaaucagagcugaaaacugaaggagacugagacaggaaaaaccauucaaaagauuaacaaaucuaggaguugguuuuuugaaaaaguugguaagauggaccgcuagcuagaauaaugaagaagagaaaaaauccaaguaaacacaauuagaaacaacaaagcggguguugccacugaccccucagaaauacaaauaacuagcagauacuacuaugaacaccucuaugcacacaaacuagaaaaucuagaagaaauggauaaauuccugaacacauacacccucgcaagacugaaaccaggaggaacuugaaucccugaacagaccaauaacaagcucugagauugaauuaguaauguauagccuagcaaccaagaaaggcccaggaccaggugaauucacagccaaauucuaccagauguacaaagaagagcugguaccauuucuacugaaacuguuccaaauaacugaggagaaaggacuccuccccaacucauucuuugaggccagcaucauccugauaccaaaaccuggcagagauaacagaaaaaacuaggccaguauccuugauguuuauuaaugcagaaauccuuaagaaaauaacuagcaaaccaaauccagcaguauaucaaauagcuaauccaccauggucaaguaggcuuuaucccugggaugcaagguugguucagcauacgcaaaucaauaaaugugauucaucacauaaaaaagaacuaaagacagccaggugugguggcucaugccuguaaucccagcacuuugguaggccaagguggguggaucaccugaggucaggaguucgagaccagccugaccaacauggugaaacccugucucuagaaacaauacaaaaauuagccaggugugguggcacgcaccuguaguccuagcuauucgagaggccgaggcaggagaaucacuugaacccaggaggcagacugcagugagccaagaucgcaccacugcacuccagccugggcgacagagcgagaauccaucucaagucuuaaaaaaaaaaaaaaaaaaaaaaccuggugcaguggcucacaccuguaaucccaguaccuugggaggcugaggcggguggaucacaaggucaggaguucaagaccagccuggccaagauggugaaaccccaucucuacuaaaaauacaaaaauuagccgggcauggucgugggcaccuguaaucccagcuacuugggaggcugaggcaggagaauugcuugaaccugggaggcagagguugcagugagccgagauggcgccacugcauuccagccugggcaucagagcaucagagcaagacuaugucaaaaaaaaaaaaaaaaaaaaaggccgggcgcaguggcugacgccuguaaucccaacagcuugggaggccggggcggguggaucacgaggugagaaguucaagaccagccuggccaagauggugaaaccccaucucuacugaaaauacaaaaauuagccgggcaugguggugggcaucuguaaucucagcuacucaggaggcugaagcuggagaauugcuugaacuugggaggcggggguugcagugagccgagaucaugccacugcacuccagccugggagacaagagcaagacuccgucucaaaaaaaaaaaaaaaaaaaaaaaaacaaagacaaaaacuacauuaucucaauagauguagaaaaggcuuuuugacauauuaaaaacucuagauaaacuagguauuaaagaaacauacuucuaaauaauaagagccaucuauuacaaagccacccaacgucaugcugaaauaaccaaaagcuggaaacauucccuuugaaaacugacacaagacaagaaugcugucucccaccacuccuauucaacauaguacuggaaguccuggccagggcagucagguaagagagagaaauaaaggguauucaaauaggaagagggaagucaaacuacgucucuuugcagaugacuuaauucuauaucuaauaaacccauagucucagcccaaaagcuccuucagcugauaaacuucagcaaagugucaggauacacaaucaguauacaaaaaucacuaucauucuuauacaccaauagcagccaagccaagagcuagaucaggaacgcauugucauucacaauugccacaaaaagaauaaaauaccuggaaauacagcuaaccagggaggugaaagaucccuacaaugagaauuacucacugcccaaagaaaucagagaugacagaugcaaaugggaaaacauuccaugcucauggauaggaagaaucaauguuauuaaaauggccauacugcccaaagcaauuuacagauucaguccuaaucguaugaaauuaccaaugacauucuucacagaacuagaaaaacuauuuuaaaauuuagauagccaggcacgguggcucacgcuuguaaucccagcacuuuaggaggcuaaggcgggcagaucacuugaggucaggaguucaagacucugggugacagagugagacugucuaaaaaaagaaaaagaaaauuuaauguuucaggaggaauaaaauaaauaacauuuaaaaugcuuauuauuagcucuuccauuuaugggaaauuaaccuaaggaaguaaucaaagauuugggcaaagcuuuauccucaauaaaaacccugugauauuugcaaacgauagcuuguacuggaacuuuuuuuuuuuucuuuugaaauggaguauugcucugucacccaggcuggagugcaguggccugaucuuggcucacuacaacauucaccucccagguuuaagcgauucuucugucucaaccucccaaguagcugggacuacaggcaccugccaucaugcuggcuaauuuuuuaauauuuuuaguagagaugggguuucaccauguuggccaggcuggccuugaacucuucuugaccucaagugauccgcccgccucggccucccaaagugcugggauuacaggcgugagcugccgcuaccggccuguacuggaacuauuaauaaguuuuacuuaacaaaaauaaaagucaucugggcgcgguggcucacgccuauaaucccagcauuuugggaggcugaggcaggcggaucucaggucgagagaucgagaccagccugaccaagauggagaaaccccaucucuacuaaaaauacaaaauuagccaggcgugguggugcaugccuguaaucccagcuacucgggaggcugaggcaggagaauugcuugaaccugggaggcagagguuguggugagcugagauugugccauugcacuccagccugggcaacaagagcgaaacuccgucucgaaaaaaauaaauaaauaaaaauaaaagucauuuugaaaagcauuuccucucagggcuaguguucuugauauauuaaguauauauacuagauauaguuuauaguauauuguagaauauauguauucuauauuucuucaauucuaagacuccauuaaaugugucauauucguguaauaacuuagugaaaugaaacacauuaagaagcauuaagguggggaugaaguauaucagagauuaucucuagaauuacuugauucgaaacgacauacguacuucuuugugccuuucgauauuauccaaaauguccauaugaucauauauuaguaaggugauguuuuuauucucuacauccuuuguguaguuauauauucauuuaaauuaaugaugguuguaauucaaagauaguuuugaguagaggcuauuaggaaugugaagaucauacuauugcugauuccugccuucgcauguugcaaauggaauuaaauguauuaaauguauuauuaguauguguuguuugaacccuacaucugacuucagcaucccuuuggugaguaccuuuuuccuuuauuuauuuauuuuuuuaccuaagaagcugaaaagagugaagauuccucuggugcugcaggccucucaggcuuacaucgcacauacagccaggacuguagcuuuaaaaacagcauguaccauguuggagauuacgucuauguggaaccugcagaggccaaccuacaaccacauaucgucuguauugaaagacugugggaggauucagcugguaaguuuguuuuaaaucaaaggacaguuuagugagauaugacuguuugacuucuccuugcuccucagggaagaaaauuuuaacucagacaucuuaagccuuuccauaauaauuguucaauaugucaauaaauguaaguaagcacccaucauaugaaaaacauaggaccuauugggcaagugucacaguugagucaaaagaaauacagcuucuaggucgggcgcgguggcucacgccuguaaucccagcacuuugggaggcugaggcgggcagaucacaaggucaggaaaucgagaccauccuggcuaacacagugaaacccugucucuacuaaaaagauacaaaaaaugagcugggccugguggcgggcgccuguagucccagcuacucgggaggcugaggcaggagaauggcgugaacccaggaggcggagcuugcaagggagccgagaucacgccacugcacuccagccugggugacagagugagacugucucaaaaaaaaaaaaaaaaaaaaagaaagaaauacagcuucuuaaagucugguugagauucauucauucauuugauacuuauuaaaaacauacuuugagccaaacuuuauguagagugacauagauucagaagaacaaaaagcucauauuuucccuugcaaaacuacuccaguaaggaagauuaugaucaaaaaagaaauuauuauagaaugacaugccuuggcuuagcauuuguuuucaaaaaggcuuucuagaacaguugccuuuaaauugagacauggaguaugcauagaaauuaaugaagccagaaguugguggaaaugugauccaggcaauccaguucuuugagcugccuaucacaugaaauacuuuuguauuccuucaccagagagcuaaauauguccuucaguagcauaucuguccccuuacuaaagugcacaacucuagguauguacuaaccagagcagaguggagcaggucucaucaccuguccuccucauuauguacuuuauauggcuuuuaauaugaagaagagccugggcaacauggcaagaccccuucucuagaaaaaauaagaaaaucagcagggugugauugcacuugcuguggucccagcaacuugagaggcugaggcaggaggaucacuugagcccaagagguugaggguguauauauauauauaugaggggggaaaaguagcaugcauuuuuuaggccucauuacacuuuauuauuuuugaguauuauuucuccuguggauaauuauauuaaacuguagcuguaaaaauaagcacagugcuagguucaugucauggcagaguggauugaugguguauuuccuaauuuugcaaagaaugugugauuucugagcuggacacagugacuuauacuuguagucccagcuacucaggaggcugagguuggaggaccacuuuggcccaggaauucaaguccagccugggcaacguagugagacccagucucuuuaaaaaaaaaaaaaaaaaaaagugauuucuguuaacaaugauucucuuucucuuccccuucccccaccccccauuuuugaggugaaaaaugguuguauggcuguugguuuuaccgaccaaaugaaacauuccaccuggcuacacgaaaauuucuagaaaaagaaguuuuuaagagugacuauuacaacaaaguuccaguuaguaaaauucuaggcaaguguguggucauguuugucaagguaagaaacucauuaaaucccaaagucucacucauucccuaggaauaaaauuuuaaaacacagaaaauaaucgauguuuacaaaauuaggaacucuguuuuaagcuauuuuuuaagccgugucuauauagcuauaugaaaagauuugggaagaaauuaaccugaacuucguugugaaagaccacuugcugcuuacacuauuuggcuauaaugcaguuagguuaaguuuuuaauauugccaggcuaauuuuuaaguaugauguuuuuuuaaggauaaucauuacaaauuuucaguuuguuuuuuagguaauaaugugugcuuuugugugucugucugauacacacacacaagcccucuucaaagcuuuaaggaacauuauagcuauaugaaauguucauauguuuucaaagagcaauuguaagcuaaauggaauuauuuguuuuuauaauuuaaaggguguguauauaauaaguccauuccguagccaaagaaauacuucuaaaucucuggucauuuauuauuuuuuguuaacugccagaaagucuguaaucaguucagcuuuuguuugguugguugguuauuugcuuuuuuuuuuuuuuuuuuugauugauuuucagaaaauucaccuaacuaguuuuauucuuaugcccuccccaccccccaggaauacuuuaaguuaugcccagaaaacuuccgagaugaggauguuuuugucugugaaucacgguauucugccaaaaccaaaucuuuuaagaaaauuaaacuguggaccaugcccaucagcucagucagguuugucccucgggaugugccucugccugugguucgcguggccucuguauuugcaaaugcagauaaaggugaugaugagaagaauacagacaacucagaggacagucgagcugaagacaauuuuaacuuggaaaagguaugcagauaauagccacacagaaaaaauuuuacaucucaaaacaccuauuccagaaaauaaaugaauaaaguauucaaacuuagaaaaagagcaacaacacaaaaccuuagccaaacaggaagaaggaaacuauaacagaaagaaauuuacacuuucaaaacuguacauuauaauuuaaaaguaaaucaggccaagugcauugguucacgccuguaaucccagcauuuugggaggccaaggcgggcagaucacgagaucaggaguucgagaccagccugaccaacauggugaaaccucaucucuacuaaaaauacaaaaauuagcugggugugguggcgcgugccuguaauuccagcuacccaggaggcugaggcaggagaauggcgugaaccugggaggcggaggcugcagugagcugagaccacgccacucuacuccagccugggcaacagagugagucucugucucaaaaaaacaaaaaauuuuuuuaaaguaaaucuaagagcuaauuauuugacaaguccaauuagauaaacugccaacuaucuaauaaugggaaaagaaagggguuaaacuucgacacaaaauguggaagaaggccaggcgcgguggcucacaccuguaaucccagcacuuugggaggccaagauggguggauuaccugaggucaggaguucgagaccagccuggccaacguggugaaacccugucucuacuaaaaauacaaaaaauuagcugggugagguggugggugccuguaaucccaacgggaggcugaggcaggagaaucgcuugaacccaggaggcagagguugcagugagccgagaucgugcuauugcaguccagccugggcaacaagagcgaaacucugucucaaaaaauaaauaaauaaauaaauguggaagaaauguaaagacuguauauuucugcuaauaaauuugaaaaccuaaauaaaauggcuaauugucuaggauauuacaaauuaccaaaauggaaucaagaagagauauaauacagaauguacaacaacaugaagaaauuuuuuaaaguaucauagaacugaccccaaagaguacugaggucagacaguuccauaggugacuuuuucuuuaagggaccuaugauuauuauacuguugaagcuguuucagagcagggagaacaagaaauuuccaguuuguuuugcaaagccaagauaaucuugauuucacaaccugaaaaauaaaaacaaaaaacugcaacucagucuuauucauguauauugaugcaaaaauuacuugggggaaaaaguaagugaaaucaaauuacuucuuugagaacaacaugaccaagaagugggaauucauucuaagaaagcaagaauuguucaaaguuagggagaucuuuaaauuucauucauuauuccauuagaucaaaggaaagauuauuugguagagaacccaucuugauuuuuuuuaagacuuucaauagguauuucuucuaguguaauuuuuuuuuaaauucauauuugugucucaagccugaagccuauaaaacaaauuccuuuuuaaauuuacacacuggacaaaggggcuuacuguucuaguguuacuuaauauuuuuugaaauuagccaauguaguuagauaaacaaaagcaguaaaaauauugacaauaaagaagcaagauggcaggcguguuggcucauaccuguaauccuagaacuuugggaggccagggcagguggaucgcuugaguccaggauuuugagacuagccugggaaucauggugaaaccccaucucuacaaaaaguacaaaaauuagccaggcaugguagcacaugccuguagacccaaccacuuggauggcugagauggggguaucccaugagcccaggagguagaggcugcaguaaauugugauugcaccacugcacucuagccuggucaacagagcaagaccgucucaaaaaaaaaaaaaaaaaaaaaaaaagcaagaauacuuuucugcagauaauugggggaaauuaacugaaaagguuggaaacagaaaauuuagcaaauagaaauuucaaaauccauauguaaaugaauagucuucauauauaaacuaguaagacuuuugaaaguaaagugaaaguguugaauacacuuuagcaacuguuagaaaaaucuuaugggagaaaauauccauuucacacuaacaacaaauuaagaaauaaccuuaacaaggaauauauagaaccucuaggaaaaaaauuuacugaaggacauaaaagacuugcauagauuguuuuugaaacuugacaaaauuauucuagcauucuuauuaagaauaaauaugugacagucaccagaaaacaagggggaaaaagggguaugaaagagagcuuugcccuuugauagugaacugagggauuuuuuuaaauuuaaaaauuagaacuuugcccugccagauguauuacauuuuauaaaacuacaguuaaaaaacaaaauuaaaacccaguacagugucacacgccuguaaucccagcauuuugggaugccaagacaaguggaucaguugaagccaggaguuccagaccacccugggcaacauagcaagaccuugucucuacagaagauuuuuagaauuuuauuuaauuuagaaaaacaguaauuuaccuauaauuuuuuuucaauaauaaacuuggaauagacgaggauuuucuguucauuauauaaaaccauugaucauuuuauugauuuaugauugaaaauacaagguuaauaaaacagucuaggguuacuguuucuaauauacaaagagcucuuuagggucuaggggggaaaguaggacuacaaaaaugagcagaggcccaaauagauaauuuacggaaagaaggcagcaaaaaacauguauuaguuaaccuaauaguuuguauaauaccuaacaggauggcaagaguugaaaagacugauaauauguguagccugguauaggaugagaccacacacacuuuucuccuauugguguuuuuuuuuuuguuuuuuuuuagauggagucucacuguugcccaggcugaagugcgguagcgugaucucagcucacuguaacguccgccuuccuggguucaagugauucugcugccucacccuccugaguggcugggauugcaggugugcaccaccgcaccuagcuaauuuuuguauuuuuaguagagacaggguuucaccauguuggccaggcuggucacaaacuccugaccucugaugauccgccugccucggccucccaaagugcuaguauuacaggugugagccaccgcccccgccccuauuaguuuuuuuuuuuuuuuuuuuuuuuugagauggagucucacucuguccccaaggcuggagugcauuggcgugaucucagcucacugcaagcuccaucuucgggguucacaccauucuccugccucagccuccugaguagcugggacuacaggcgcucaccaccacgcccgucuaauuuuuuguauuuuuaguagagacgggguuucaucguguuagccaggauggucucgaucuccugaccucaugauccgcccgccucggccucccaaaguacugggauuacaggcgugagccaccgugcccggcccggugucuuugacccagcaguuugauggcaaagaauaugcuccaaugguaguacucaaacaggugcuccgaaagauucuacguaagaggcgacaucauggggcugggaaagaaugugauuuuuuauauuuuaucaguaugggaauguguuggaaucauaaaauaauuucuuuuaaaagcagaauuauccggucgggugcaguggcucacaccuguaaucccagcacuuugggaggcugaggagguuggcgugguggcaggugccuauaaucccaguuacuugggaggcugaggcaggagaaucacuugaacccaguagguggaggcugcagugagcugagaucacgccacugcauuccagccuaggcaacagagcgagacuccgucugaaaaaaaaaaaaaaaagaauuaucaauggaagucagcaugauaauuaacuuagauuucuuaccugguauuuagaagucucuaggaacucucuguauaugaguuacuuggucuuuuuuggucucauaucuuuauuucaauauuauaugaccaagacaggucauucaggagcuuuuuuuuuuuuuuuugaaacggagucucgcucugucgcccaggcuggagugcaguggcgcaaucucagcucacugcagccuccacuucccagguucaagugauucuccugucuuagccuccugaguagcugggacuacaggcgugugccaccaugcccggcuauuuuuguauuuuuaguagagacggauuucuaccauauuggucaagcuggucuugaacuccugaccucaggugacccacccaccucaccuucccaaagugcugggauuacaggugagagccacuacucccgaccggaacuuuuuuaaagaauaacuuuaggccgugcucgguggcucaugccuguaaucccaucacuuugggaggcugaggcgggcagaucacaaggucaggagaucacgaccauccaggccaacauggugaaacccugucucuacuaaaaauacaaaaauuagccaggcgugguggcacgugccuguaaucucagcuucucgggagguugaggcaggaaaaucacuugaacccaggagggagagguugcagugagccgggauugcgccacugcacuccagccuggagacagagggagacuccguaucaaaaaaaaaaaagaauuacuuuagaauagaacccauuccuuaaaggaaaagguauuauuaaucucauggguuguuuuauucacagcuuccauucuuucagaugucccuugccugucauguauauggaaccucucugauucuuuuuuuuuuuuuuuugagacagagucugcccagguuggaguauagcggcacaaucucggcucacugcaaccuccgccucaugaguucaagcaauucuugugucucaguuucccaaguuccugggacuacaggcgcgcaccaucaugccuggcuaauuuuuguaucuuuaauagagaugggguuuuaccauguuggccagucuggucucgaacuccuggccucaagugauccgccugccuuggccuuccaaagugcugggauuacaggcguaagccaccacucccggccuucccucauucuuaaucauuuuccaagaauaccauuucaguaucacauuugaagucauaaagaucagaauguuaaauuauuuggacauugugaaggaggaauuuuuuuaagugugaaguuugaaguauucucaggaagaugcuauagaaaacuuggaggcuuuggaguuuccucagcuuauauauguuuuggaguuaauauauuuauaacaucuagccuugugccgauuaucagcuagguucucaguaaaugaugguucuucuuuaccaucuuuacauuagugagaaguaucuucuuuuugcuuuuucuuuuuuagucaggacuauaaaacaacaguaauaaugaugucuguuaagugguuuuuaugaguuaggcauuuuucuauguacuugagcauggauuaugucacuuaagcuucguaaacaacccuaucugguggccacacuaucauuaucuucauuucacaaaugaggaaacuaaggcauaagaggucaaauaauuugcccaaagccauagcagucauuaggugacagaugcuguaauuuauuaaaaaacagagcauguuuggcugggcgcaguggcucacgccuguaauccccgcacuuugggaggccaaggcggguggaucacgaagucaggagaucaagaccauccuggcuaacacagugaaaccccgucucuacuaaaaauacaaaaaaaaaauuagcugggcaugguagcgggugccuguagucccagcuacuccagaggcugaggcaggagaauggcgugaacccgggaggcggagcuugcagugagccaauaucgcgccacugcacuccagccugggcgacagagggagacuaugucucaaaaaaacaacaacaacaacaaaaaaagcauguuuauaucacagaggcuaugcuauuccuuuccauguuggaauaaaucaaaauaguaaaaauuuuagaucuaucaguuguuuuuugugguuuguuuucuuuuguuugagauagggucucauucuguuucccaggcuggagugcaguggcacgaucucagcucacugcaaacuccaauugccaggcccaagcaaucuuccuaccucagccucccaaguagcugugaauacaggcgcaugucaccaaagacagcuaauuuuuaaauuuuuuuggaaaugagaucucacuguauugcccaggcuggucuugaacuccuggcucaagcaguccucccaccuuguccucccagugugcugggguuaugacauaagccacugugccuggccuaaaucuuaucaauuguuaauguuaagacauuaagggagcccaguaaaugugauagagaggaagcuuguauagaauuugccccuuacacuauaguaaugcaugaaugagucugcuuuuaaauaccgauaaauccucuccaguuuuuuuguuuguuucuaaaggcagugggaauugagagcaggagggagacaggauaaaagcaucuugggauaauauuguuuuaugaaaauuaacuagaaauuucaaauagauacuugauaagucuucguuuauuucaauaaucuaauuguuuuguuuccuagccuccuucagaguuucucuuuauguuuuuuuguuuguuuguuuuaauuuacuuuuuucuugagacagggucuugcucugucgcccaggcuggaguacaauggcgugauccuagcucacuguagccucgaccuccugagcucgagugaucuacccaccucagucucuuugaguagcugggacuacaggcaugcgcuaccaugcccaacuaauuuuuuauuuuaauuucuuucuucaguugagacaaggucucacuauguugcccaagcuggucucaaacucuugggcucaagcgaucguccugccuuggccucccaaaaugcugggauuacgugagccacguaaccaauggugguuuuuucuuuuaaguuaaugugaaagaaaagucugcuuucguuucuuaccuucucuauuccuugauuaucaacuaccuuucuucagccaguuuucuuuacaacaggaaaaagaagaugucccuguggaaauguccaauggugaaccagguugccacuacuuugagcagcuccauuacaaugacauguggcugaagguuggcgacugugucuucaucaagucccauggccuggugcguccucgugugggcaggugagugucauugaauuagggaagaugagguugaaucugagaaauuuggaaccaguagaaauuagucacccuucggaugaagacaaaaguccuuccccuggcaguuucuccagcuucuucucacaccauguuccccuccaaccacacuuucuuccuuaaauuaucccuuugggcucuuuuguuuucuuccacuauuuacagaacuuucagcucagaaaucucccugccuacuucauacaguaaacuccuuuagcauaaauuugaagugacacuuucuuaaaaggaagucuuuccuguccacugcagaauggguuaagucucccuguugcacacucucaaagcaccacauauuuccuucuccuuagcguauauaucacauaucgguguucauuguguuauugucagguuucacccuuguauucccugcucaaaucauagugcaugaaacauaguagggccucagauauuugaugaacaaguaaaugacaaaaggaugacaguaugguugaauggcaaacacagcagagucugguauaggguuggguaggagaggauaguggcuaagaacaguaguucauucccugagucccagcucuguuaguuguagguccuuaggugaaugauuuagcccucuaggcuucaguuuauaucuguucaucauucaguaagcauuuauuauaccuacuauuuaccaggcucuguggauacauuagugaauaaaacagacaaauauucuuuuuccuggggagcuuuuuucuagugugaagacaaacaacaucuugaauaaguaaaguguauaguauguuaggucaugauacgugccguagaaaaaauagaggagaacaaggggagaagggggucccauggucagagcagggagaaugguuuauauaggccucacugagaagucggcagcugaaccaacacuugaagaaacugagaaagugaauaaugugaauauccagggagaaaggauuccaggcagugggaacagccaguauaaacaccugaggagaaacaugccaggccuguuuguuaguaggagagugagccauuaaugaguuaguaagagauaagugccagggguagggugcauaucacauagggccucagagaccauuauagggauuuggguuuuuacugaguuaauggagugccaucgauuguuucaagcacagagugacauuugguuuagaucuuaauaggauugcucugccuauugguuguugagaauagacuguaaaaagucaaggcagaagcaaggagauccaccgccuaggaugcuguugcaauaauccaggcaagaacaaucaugcuucagaccagggugauugcaaaagauaguauuuugaaggucaaauuaauaguauucuugauaaauggaguguggggucugagaaagauaaaaaagucaaggaugacuccuguguguaagccugaggaacaggaagguugcaguuaccauuaacugaaauaaguaugauacuucaggucaggaaucacgauaauauggagcaauaauaaugucagcuuuauggguuaguugucaagaauaauggcuuucaucaaauucugaaggggugaaggggcacuagauuuuuuuuuuuuuuuuuuuuuuuuuuugagacauugucugguucugucaccuaggcuggaaugcaguggcaugaucuuggcucacugcaaccuccaccuccugggcucaagccaucuucccaccucagccucccaaguagcugggacuauaggugcacacugccagggcuggcuaauuuuuguauuuuuaguggagaugggguuucaccauguuguccaggcuggucuugaacuccugagcucacgugauucgcccaccuuggccucccaaagugcugggauuacaggcgugagccccugggcccagccagggauauuagaucuugaccuucaaaaagauuauaaaccacugucuuaaaggaaugucugccacucaugugaucugaccccaaauauugauguuuuaugucuuuguuugguucacaaguccaaugacaaaugcuuaguucuguuuucaucaugaacgucucaggaagaaaaccuggucauuagauaaaacuauuaaguuuugugccuugauauuaaguuaaaaaauuuuuuucacuuggaaaaauagucaaauguuccuuucucuuuuucuaaguaucuuuucauguguuuaaugggggaaaaaauuaaugaaguugucuuaccaaaacagccagugaaacuccucugaaugguacacauuacuaaguuuuugguuaaugcgauuuuuguuagauuaauccuucaagaaggaaacuauuuuaauguaauuuauauauuuuccuccccaagaauugaaaaaguauggguucgagauggagcugcauauuuuuauggccccaucuucauucacccagaagaaacagagcaugagcccacaaaaauguucuacaaaaaagaaguauuucugaguaaucuggaagaaaccugccccaugacauguauucucgguagguauuugugcuuuuuuauuuaaucguguuuauuccaucaaaauugauggaauacuacuucuguggggcacuguucuagguguuagguauagagcagugcccaaauccaaaucucuguucucuuauguuggggcagagauuggggagucagucgauaaauuaaaaaauaaauauauagaauaucaggugguaauuagggcacaaccaaaccuuucaccucagccuuccaaguugcugggacuauaggcaugcaccaccgcacugagcuaauuuuugaaagauaguuuuccuagauauagaauucuccauugauaguuuuuuuuguucaugucuuucaucagauuuggggaguuuuuggccauuucuucaaauauucuuucugcuccuuucucugcuuccuucaggaacucccauuauacuuaacguugguacauuuaauggugccucacaggucucucagacucuucauuuuucuuuaccuuuuuuuuccuuucugcuccucagacuggauaacuucaaauggccugucuucaggugcauucauccucugccugcucaaaucuucuguugaacccuucuaauaaauuuuucauuucaguuauuguacuuuucagccccagaauuuaguuuuuauaauuugucucuucauuuauauucacuauuugcaaugacauuuuacugguuuccuuuagaucuuggaguauauuuaaaacaguugauuuaaggccaggcaugguggcucaugccuguaaucccagcacuuugggaggccgaggcggguggaucaccuaaggucgagaguuugagaacagccugccaacauagugaaaccuugucucugcuaaaaaaaaaaaaaaaaaaaaaauuauuugggcaugguggcacaugucuguaauccuaguuacucuggaggcugaggcagaggcagaggcagaggcagaggcugcagugagccaagaucacgccacugcacucuagccuggaugacagagcaagacugucucaaaaaaaaaaaaaaaaaaaaaaaaagacaauugauuuaaaguauguguuuaguaaauccagugucuggaauuucucaggaacaauuucuguucauuuuguuuuuucuuaugaaugggcugugccuucuuguuucuuugcaugccugauaauuuuuuguugaaaagugcucauuuuggguauuauaacaugauaacucuggaaaucagauucuccccauccucaggcuuuguucuuaauacuuauuauagguuaugguuguuuguucagugacucuucuaaacguuuguuuguuuguuuguuuguuugguuuguuuuaaagauuguauuuuuggcugggcacaguggcucacaccuuuaaucccagcacuuugggaggcugacaugggcaggucgcuugagcccaggaguucgagaccagccugggcaagauggcgaaacccugucucuacaaaaaaauacagaaauuauccaggugugguggucuauauccauggucccagcuacucaggaggcugaggugguaggaucacuugagcccagggaggucgaggcugcagugagccaugaucaugccacugcacuccagccugggcaacagagugagacccugucucaaaaaauaaaagauuuuuguuguuguuguauaugguuacuacagucucuguucuauaagcuuagugaucagccagugauuugacagagguuuucguaaauacguggagccaauaaaaccauaaaacucccagucuucacugcugacuucucugcguaugguggagcacaccuucaacacucagccaugcagauuacaacucugcuuugccuuuacuuccuacuugugcagagcuugaaggucagccagaaaugagaucuuagggccuucuuagguccuuucugagcauguacacuauuguuggcauguguguggccuucuaggcucccaggaauguguggaaacuuuucaaaacccuuauuggccaaagcaucucacuccucaucuuuuccucugaggccuuuugucauaucuacuguugguccugacugauacccuuugccccagccggcaacagcugguucauuugacuuuaaaugugcugugauuugaauguuugugcccccuucgaaauucaugacuuaaaguguaaucccuagugcaacaguguugggaaguggggacuuuuaggagauguuuaggucaugagggcuuguccucgugaauacaauauugcuuuuauaaaaagggcucauguaaaugggucugcucugucugaauggguuugcugucucuuacacucuugcccucugccuucugaaauaugaugacauagcaagaaagcccuugccagaugcuggcaccuuuaucuuggacuuuccagccuccagaacugugagaaaacuguucuuuauaaauuacccagucugugguauucuguuauagcagcacaaacaaacuaagacaaaauguuuuugacaaaaaaaccuagacacuucuccaccaagggaauuccaagcuaagcacaauaaaggcaagcacuuugcauuaguguuuagaaagcugccugacaggucaaaacagaugaccacaguucuuggagcauggagcuguuuugcuuccucuaucaccacaaucuuacaccaggaauagaggcugccaucuucaaggcugccacugagacagaaaguaaggaauggagugaggguaaguuaaaaugccacagagcuuuccugccaaguuucagucacuuuuuuucuuaauuaagcauuugcuugguugcuguaaaccuuugacuaucuuacagaauuccaauaaaguuuauucugcuuuuuucacuguuucugugaaguaauggcccuuagagcucacuacuccuccauauucacugacauaacuuggaguaauuucuuucuaaagaugccuguuagaauguguuacauucuggccgggcaugguggcucaugccuguaaucccaguacuuugggagguugaggcaggcagaucaccugagauuaggaguuaagagaccagccuggccaacguggugaaaccccaucuuuacuaaaaauacaaaaauuagccgggcgugguggugugcaccuguaaucccagcuacuagagaggcugaggcaagagaauuguuugaacccgagagguggagguugcagugagcugagaucaagccacugcacuccagccuguggcuggagacagagcaagagacucuauguaacaaaaaaaaaaaagaaagaaagaaaauguguugcauucuacaguuuaucuaccaguuuuauauccaggaucucauuuaauuuucaacaugacccuggaagaaagaugcugauauugucagaaaggugaaguuacuacccagggagugggccagaacuaaaaccuagguuuuccuaauucuucuuuaguuagucuacagcuagcuggcacacuuuugagaauuaaaggaggugccaguaauaucagguaggacaacaggcauauaaugaaauauaaguaacuucaucuugagauaaaacccaaaagaaaaugcaucuaguaaucacaaagugggauuucagccuagcuuguggaauucacuguccccagccuccaaggaaaaaggguuuuguuauauaagcuuuagagaauuuauaauuucauuguauuaacucuaaccacuauuaaauguaaaucauauuuugcacuuuuuugugucucugaaauagaaguuuugaagauaauuagaugagguguaucauuuuuucaucuucuguuacauacaaaggagacaauccuguuuuuccaacgguuauguucuuuuuucaguuucguugaagaauuguuuucauuuacuuaaacaguaaucaagcugggcacaauggcucacgccuauaaucccagcacuuugggaggcugaggcagguggaucacuugagaucaggaguucaagaccagccuggccaacaugguaaaaccccaucucuacuaaaaauacaaaaaaaaauuagccagcugugguggugcauuccuguaaucccggcuacucagaggcugagggaggagaaucgcuagaaccugugagggagagguugcagugcgcugagaucacucuacuggauuccagccugagugacagggugagacuccgucucaaaaaaaaaaagaacuuaaacaguaaucagauggccacauguggcagacaguaccucuacccuuaaccccuuaggugauaaaauuuccaggaaccugggcucuugaaacaugccgauuccuaauuuauuugcagguuuuguucccuucacaguagauuuuuauaacguuucauuaauuuaaaaacuguccucaguaaggcaaggaagauaaaagaucuaaagauuugaaaggaaaaacaaaagggccuuuuuuuuuuuuuucaaaaauauuagguauguagaaaauccaagagauauucagauaaacuauuaaaauuaguaaaugaaaauaugaaguuuuuuuuguuuuguuugagacaagaucucgcuuuguuauccaaacuggagugcaaugguacaaucauaacucacugcagccuccaacuccugggcgcaagcaauccucccaucucagccuuccaagaagcugggacuauagggauguaccaccacucccagcuaauuuuuuuuuuuuuuuuuuuuuuuuuuuuuuuuggggagaugagguaucccucuugcucaggcuggucucaaacuccuggccucaagcauccucccugcucagccuccccgaaagugcugggauuauaggcaugagcuaccuuaccuagccccaauauuucuauuucuguaucuguaucccaucagugagcaauuagaaaauuauuaccauuugcauucaauaccuaggaauaaaucuuuuuuuuuuuuuuuuuuuuuuuuuugagauggaguuucgcucuuguugcccaggcuggagugcaauggugcaaucucgguucaccgcaaccuccaccuccuggguucaagcuauuccccugccucagccuccugaguagcugggacuacaggcaugcgccaccaugccaggauaauuguuuguauuuuaguagagacgggguuucaccauguuggccaggauggccuugaucuccugaccucgugauccaccuuccucagucucccaaagugcugggauuacagacgugagccaccacgccuggccaaucuuuuuuuuuuuuuuuuuuggagacagugucucguucugucguccaggcugcagugcaguggcacaaucucggcucacugcaaccuccaccuccuggguucaagcgauucuccugccucagccucccgagcagcugggaccacaggcgugugccaccaugcccagcuaauuuuuguauauuuaguagagacagcauuucaccauguugaccaggauggucucaaucucuugaccucgugaggcgccugccucggccucccaaagugcugagauuacaggcaugagccauggcacccagccaggaauaaaucuuuaaaagauagccaacgugguagcucaugccuguagucccaacacuuugagaggccaagaugggagagucgcuugacaccaggaguucaagaccagccuggacaacagaaggaaacucuaccaaaaaaaaaaaaaacgaagaaacaaagauguguagggcaccugcacacgcaugugcacacaugugcgcacacacacacaacuauaagaaaauuauugagaaauugaagacauaaguaaaugaaaguuauccaucauauuuauagcuggaaaauucaauauuaaaaagaugccaguuccccccaaauugaucuauugguucguuccaauuccaaucaaaauccagcaggucuugauaauuuuuuuauacuuuauuaaaugaaguuuucuaaacuuucaucuuuucccugucuuuugggggcuugguaggagcuccaagucaggacacagagauaccaccuccauuccaaagccaccaaucacuuuuacucuuugguuguaagcagaauuauuauuuuuuccuaaugucuauuuuuccuucuauaaaauauggaaaauuguaauuaucccuuuucugaauuaaaaggccuuugaauuauguaaauaaaagugcuguguaaguucaaagcagugauaguaauuguagcuauuuuaagcuuuggaaauguuucugaccuguuuuucauauacauguuuaguaaguuguuagcuaugaacauuccuguuaaggucaagagcaaaauagggauguucuggcugggugcgauggcucaugccuguaauuccagcacuaugagaggccaaggagggcggaucaccugaggucaggaauucgagaccagccuggucagcauggugaaacucugucucuacuaaaaauacaaaaauuagcugaugugggcgugguggugggugccuuuaaucccagcuacuggggaggcugaggcaaaagaaucacuugaacuugggagguggagguugcagugagccaagaucgagucacuacacugcagccuagcgacagagugagacuccgucucaaacaaaaaacaaaaaaagaaaagaaacaaaauagggauguccuuaucacacuuauuuaacauuguucuagagguacuagccaguggaguuagaagaaacagaagucuaaaauaagaaaaguaaggaggugaaaauucaagagcaucaacuaagaaaucauggcaaacaguaagagaagugagaugauugaauauaaauaaauaacaaaccuauuaucuuaaaagauucaguacuaauaaaauaccuuagauaaacuuaacaagauaugccacaucuguaugaaaaaaguuuuaaaaugcuauugaaugaaugcuugaacaaauugcaaagcaguaccauaugccuagguagguuucaaugucauaaagauguccauccucccuaaauuaaucuuuaauaugaucccauuagauauaccagugggaauuugcuugugaggaaguugauacuaugugaacucauuuuaaaaaucauauugaaggccgggcgcgguggcucaugccuguaaucccagcacuuugggaagccaaggcgggcggaucacgaggucaggagaucaggaccauccucauuaacauggugaaaccccaucuuuacuaaaaauacaaaaaguuagccgagcauggcggcgggcgccuguagucccagcuacuugggaggcugaggcaggagaagggggugaaccggggaggcggagcuugcaaugaaccgagaucgcgccacugcacuccauccugggaaacagagcaagacuccaucuaaaaaaaaaaaaaaaaucauauugaaaaagaaacuuagaaucgggugcaguggcucacuccuguuaucaaucccagcacuuugggaggccgagguggguggaucacuugagccuaggaguuugagaccagccugggcaagauggcaaaaccucauuucuacaaaaaguacagaaauuagcugaguggcacuugucuguagucccagcuacccggaguagggggcugaggugugaggaucgcuugagcccaggagguugaggcugcagugagcagcugucaucucaccacugcacuccaggcugggcaacaaagugagacccugucucaaaaaaagaaaaaggaacucaggaaaauucugaaaaguauagugaaaggggaucuauccuuaccagauauuaaaacauuauagcacuacaauaauuaaaacuauaugauauaugaguaaacagguuauuugaacaaaauagaaaguuuagcaaauauaugguaaaaguggcauaucagguaaguggggaaagaaguauuuuucuccaaaugguguuuggaaauucaauaaccauuuggaaaaauaaaauuguagccauaucccacaucuuaacuucaggauagauuuccagaugaauuauaaauuuaaauaaacauaaaauuaaacaacaaagauaccaaaagaaaccaugagaaagaaauuuuguuaaucucugacauaaaagccagaacucauacaauaaaauacugauaaauucagcuguauaaaaauggaaaauaucuauaugaccaaaacuggcaaaaacaaaaaugacaaucuugagaaaauauuugcaauguuuaucauagacaaagaucugauuuuccucauagaugaagagcuccuauaaagcaauuagauaaagaucaacauccagcagggaaauaggcaaagaaaauaaaggagagcagaaauaaauuacuagggcccagugugaugacucacaccuguaaugccagcacuuugggaggccaagguggguggaucaccugaggucaggagucgaagacuagccuggccgacauggugaaacccugucuguacuaaaacuacaaaaauuagcuggacaugaugguaggcaucuauaguccuagcuaccugggagacugaagcaggagaaucacuugaacccaggaggcagagguugcagugagccagaaucgcaccacugcgcuccaaccugagugacagagcgagacuccaucuuaaaaaaaaagaaacuaccagugauucuuaaacaaaugaaaauauacccggcugggcacggugguucacaccuguaaucccagcaguuugggaggcugagggaggcggaucaucugaggucagaaguucgagaccagccuggccaacauggugaaaccccauuucuacuaaaaaaaaaaaaaaaaaaaaaacacaaaaauuagccaggcaugguggcacacgccuguaaucccagcuacucgggaggcugaggcaggauaauugcuugaaccugggaggcagaggcugcggugagcugagaucaaaaaagaaaagaaaagaaaauauacccaaccuuggccauuagagaaaugcuaguuaaagcuacccaggugcuuuucuucuuuucuuuuucauuuuucuuuuuuucuuuuuucuuuuuuuuuuuuuuuugagauuaccuaucaaauugucaaagauccagaagacauuucucacuaguugacaagagcaugaggaaaugguauuuaccuacuuuguggguagucugugaauuaggacacccuuuauggaaggcaguuugauaauaccuacaaaaauuuaaaaaguguauacauacccuuuaacccagcuuuuauaguucuagaaauuuaugcuucagauguauucaccuacgugcaaauugauaugucuuaaauuauuuauuucagcauuauuuagcgucagcagaagagcaaacauugggaaacaacauagauacccaucaauagggaacuaguugaauaaacuuaguacauucauacaagccgugaccuccaagacauauuauuuugugacaaaauucagaugcaaaacaguuuuaagugauaugcuaccauuuaugggaguuuuuuauuguuuuauauauaugucauagaauucaucauuuuaaccuuuuuuuuuuuuuuuuuugagauggagucuuucucugucacccaggcuggagucaguggcacagucucggcucccugcaaccuccgccucccagguucaagcaauucuccugccucagccuucugaguagcugggauuacaggcgcaagcuaccacgccuggcuaauuuuuguauuuuuaguagagacgggguuucgccauguuggccaggcuggucucaaacuccugaccucaggugauccgcccaccuuggccucccaaagugcuaggauuaccacgcccagccuuaaccguuuuuaaauacacaguucaguggcuuuaaguccauugacaauaccguacagcuaucaccacuguucauuucuagaauuuuuucauuaucccaaauaaaaacuuuguaccuguuaaacaacucuuuauuuuccccuucccccuggcccuaguaaucacuguucuacuuuuuuuguucaugaauuuugccuguucuauauacugcauauaaguggaaucauacaauauuugucccuuuggaucuggccuauuuuacuuagccuaauguuuucaaggcucauccauguuguaucauauaucagaauuuuauuccuaaggcuguauauuccauuauauguauacuacaucuguuaauggacauguagguuguuuucacauuuuagcuauugugaguaaaacugcucuuaccagugguguacaaguaguugauccucugauuucuuuuggauauauaccuagaaauagaauugcgaggucauaugguaacucaguguuuaacuuuuuggagaaacugccuaaauauuuuccacagcagcugcaccauuuuacagucccaccaagauacaaggguuccauuuucuucacauccuuaccaccacuuguuauuuucuguuuuggguuuuuuuuuuaauacaggcaucuuaauggggugugaaguaguauuacauugccguuuugauuugauuuuccugaugaugaaugcuguuaagcauuguguuuuuuuuguuuuguuuuguuuuguuuugagacagagucucgcucuuucgcccaggcuggagugcaguggcgcaaucucggcucacugcaagcuccgccuccuggguucaggccauucuccugccucagccucaugacuagcugggacuacaggcgccugcaaccacaccccgcuaauuuuuuguacuguuaguagagacgggguuucaccguguuagccaggacggucucgaucuccugaccucaugauccacccgccucggccucccaaagugcugggauuacagacaugagccacugcgccuggcuaagcauuguuucaugugccuauuggacauucguaugucuuuuuuuagagaaaugucaauuuauaucuuuugcacauuuuuuaauuggguuauauauuugucuuaauguugaguuguaggaauauauauucuguauacuagacucuuacuagauauaugauuugcaaauauuuucuucuauggcuuaucuuuucacuuucuugauaguauccuuuggagcacaaaaguucuuaauuuugauaaagccccuuuuuuuuuuuuugagacugagucucgcucuauugcccaggcuggagugcacuggggugcucuuggcucacugcagccucugccuuccggguucaagcaauucuucugccucagccuccugaguagcugggcuuacaggagcgcaccaccaagcccagcuaauuuuuuuguauuuuuaguagagacgagguuucaccauguuggccaggcuggucucgaacuccugaccucaggugauccacccuccucggccucccaaagugcugggauuacaggcaugagccacugcacccagcccauuuugaauuaauuuuuuuuuuuugagacggagucucgcucuuucgcucaggcuggagugcaguggcgucauccuggcucucugcaaccuccgccuuccagguucaagcaauuuuccugccucagcuuccugaguagcugggaguacaggugcacgccaccacgcccagcuaauuuuuguauuuuuaguagagaugggguuucaucauguuggccaaggacggucucgaucucuugaccucguguuucugcugccucggccuccccaaaguacugggauuacaggcaugagccacugcgccuggccaaauuaauuuuuauauaugauaggagguaggaguucaacugcauucaugugcagaaguggaaauccaguuguccugguaccguaccaucuguugaaaagaguguucuuucccccaaugaauugucuuggaacccuuaucaaaaaucaauuauccauaaaagcccuauuauauugguuuauuucuacacuuucaguucuauuccauugaccuauauauucuauccuuaugccaauacauauuguauuauaucuuuuuuuuuuuuucuugagauagggucucacucugucacccaggcuggagugcaguagugcaaucacagcucacuguagccucagacucagacuucccagacucagaugauucccaccucagccucccgaguagcugggaccacaggcaugcaccacaacauccagcuaauuuuuuguauuuuuuuguagaauuugggggucucacuauguugcccaggcuggucucaaacuccugagcucaagagaucugcccacuucagccucucaaagugcugagauuacaggcuugagccaccaugccuagccccuuucauaucuuuaaaauuguuaauuauaugaauguauucauccaaaaauaauaaaauguuaaaacaguuaguaacuaugaccacaguuuacuccuuuaauuucuuucuaauuuucucuuucaggaaagugugcuguguugucauucaaggacuuccucuccugcaggccaacugaaauaccagaaaaugacauucugcuuugugagagccgcuacaaugagagcgacaagcagaugaagaaauucaaaggauugaagagguuuucacucucugcuaaagugguagaugaugaaauuuacuacuucagguaaagcuugaaaaacuuaaggaaaaaagagcacuuccauuaacugauagcaacauaguguaguccaguguuuuuaauuuuuuauuagaucuuaaacuagaguaguaaauauuucaaauagaaaauauuuauucacuuaaagauuaaaggaaagacuucauaaucugcugggaccugguggcugcucuaauagugcccuuggcguagacuccaauaauuguggaaugaggcagaaacacuugguucugguuuauauccugucaggagauuucucaguuccacagauuaugaaaacucuuuuugcuguguauaggcaacuagaucccaacuuuggacacaauacuuuuguggauauucagcauaauuauuuaaaaacaagcaucucuaaguacaaguaauuucauaaauacacauuuaaacucuuuccaugcugccuuuagagcauauauugcagauugcaggaagucacuucuaguuguuaagguggaacacugcuuuccggcuuauucuggaggggcauuaggugauuuuagguuuuuuaugucacuuuuuucagaaaaccaauuguuccucagaaggagccaucaccuuugcuggaaaagaagauccaguugcuagaagcuaaauuugccgaguuagaagguggagaugaugauauugaagagaugggagaagaagauagugaggucauugaaccuccuucucuaccucagcuucagaccccccuggccagugagcuggaccucaugcccuacacacccccacaggugaaggugacagguuccuguuacuuaucuuauuaccaccuuugguuugcagcagacucaaaaccaaaguaaagugacauccagccccuccauaugugagcuuuaacuuagaauucugcaggaaggaacagauuuugucagugccaugauuuauucauuuauuuuugauugacaaaaauuauaugucaucccauuaauaauuuauauuaauaccauuaauaauuuaaaauuaauaucuuuaaaauuucauagcuauuuuaauggugggcuuaguuagaagacucuuccuugugcugaagaaaagcaguaaggagcaacaucacccuguuugucuuuagcuuuuauuacccgugucuuuuuaaucucuccuuauguaggaccucaucuuuugguugaggugauuguugguauuuuuuucucauucagaauuuuuacaagacuuggccaggcaugguugcuuaugucuguaaucccagcacuuugggaggccaaggcaggaggaucacuugagcucaggaguucaagaccacauugggcaacauagugagaucucaucucuacuaaaaauuuuaaaaauuaggcauggugaugcacaccuguagucccagcuacucggcaggcugaggcaggagaaucauuugagacugggagaucaaggcugcagugagauaugagugcaccacuguacuccagccuggugacagaacaagacccuguaucauuuaaaaaaaaaaaaaaaaaaaaagaauuuucucaagacuuaauugugaggucaccauuacagauugcacccauggaauucagugaaacuuucauuucuuuuuuacuuguaauagauaaggaagagguguguuuugaccaagaaaauagccagcuauaaaccaaacgugucaauaaagcaguaacuagugaaucacguguuccuggcuucugaaaaauuuuuuuuuuuuuuuuuugagacagagucuugcucugucgcccaggcuggagugcaguggcgccgucuuggcuuaaugcaagcuccgucucccggguucacgccauucuccugccucagccuccugaguagcugggacuacaggcgcccgccaccacgccuggcuaauuuuuuguauuuuuuuuuuuaguagaaacgggguuucacugugucagccaggauggucucaaucuccugaccuugugauccaccugucucggccccccaaagugcugggauuacaggugugagccaccgcgcccggcuggcuucugaaauuuugagcaguuaaccaaauguaauguuuugaugcaccauaagaccuuucugucuuacagucuaccccaaagucugccaaaggcagugcaaagaaggaaggcuccaaacggaaaaucaacaugaguggcuacauccuguucagcagugagaugagggcugugauuaaggcccaacacccagacuacucuuucggggagcucagccgccugguggggacagaauggagaaaucuugagacagccaagaaagcagaauaugaagguaaauagagccuaggcacaacugucuuucgaagcaaggggguguuucaggaaugcacgcgcacagacagguuuuacucuuguucuuaccacuugcacaugaacuuuuauuuuggggacuguuccaaauggcacccaaccaguauuuuagaugcuagccuuguccugacugagcagagcacugccccugacuuggccucugauccugguguuguauuuuccccugcaaauuucuccaaaauauuuugcuacuaaaaauugcaugauuuuuuucuuucauugagcccuguaagcacacauguugagcuagggaauuauuguacaaugauguuaaauauaauuuuaauuaaaauucgucugaaaagggccucuuaaaaucagugaucuuguguuacagcucuugguaagccauauauuuaaacuucaggcugagucuuugcuaaagugcuugguuuccuaggucaguccuggccuauacugugucuguauucauagcuacuucuaagguauuugggucuuuuuuauaaagcucaacugccuuuauuuuccuuuuauucuaauuaaaucacuuugggcagugagcugucauucaagaauuuggugguucuuagccauuuagagacaaauacuugagauuuuuuguuuuuuguuguuggguuuuuguuuuuguggguuuuuuuuaaauaucagacauggacuuaguaaagaaauuaguaguaagcauuagauuaggcaguacuguugcccuuugagcuauauuuuuuccaucuggaauuuuauauauugguucauuuugccaguuuagagcuccucucuacaauggucaaccacuacucuucuuagguggguacaguucuauuauuuucuggcaaacauuaauuauuuaggcugccccuuuuauuaaaauuuuugaagucuccaaagaaacuucuuuaaaaaaaaaaaggucauuuauuauaauuauuugauuacuaugaaauuaucugacaggcuuccccaaggaucuucugcaaagaauccuaauccugcaagauguuuagccaaaaaacauuuuguggcaaaaccaguuugagaagcauuccaaacucucucucuuggaaacuuauggugcauauucccguauguguguugucaggcccaagggccuccucuguccuuaucaaggggagugcuaaccuuuucuccuuucauacagcaugcauauucccauauuaaaggcuuuaagaccaccaguaaauaagcuguuuuauauuaucuggcauuuucugaaauuugaccagguauuuauguaguaccuaugaauacccuaaagaacuaacauuuugcagaauauucuuuggaaaacccuagucaguuccauaagaaccuagaacuuuguggagcuuugauauuucugaccuuauugaaaguuaagaccuacuacaccacugagcuggaggaguguugaaaaucaagcucacaugaauauugcugagcgagcagcacagcagcagcagcaaggcaaauggagccagugcuggauggcugguuauuuagagugugagcaggagagagauaccugaagacacugugaagguaaaaacacuggaguaggaaugaagagagggagaggugauggcgucuggaacauccuuccaaauucaaaggggagucugaaagugagugagaaccuagugaggggggaguuauaugacucagcagcaucuaccugagacauaaaaucugaacuuuugauguuuucucucauugaauucaaagcccaaaguuuagaguuuggguagccaguccaauauucaauccacaggccuuauuuuuuuuuuuccauuucauuuuuuugcuuucccacuuuacugugucacuuguauaaugaaaauacuagaauuugaaguggaacccuaggucgauuuuuuuuuuuuuuuuuacugcuagcucaaguaaauaguuuguucaaauggccuucguuucucauacucauuguacaaagggucuguaaacuaggacagucuuagugaugauaaggcuaugcaggcaacucugucacagccaagaggccuuugauugcuugacuuucauauucuuaaaggaggacuggagcuguagcuucuugauucucuguaaagccauaugaccucgagcuauuuucccccuccugaaaucagugguguugaguuccauguuaaaggguuuauguguggcaguuggagugugauaucaggaguuagggccauaggguugcugguucucucuauccuuggacaagugacugccugucucccagccuccauuugccuaugugaugaguggggggaucuucuauuuaugaauggugagacaagaaacccuguauggugggagcuuuggaaauacagcauuucaggaguucuucaguagggguucagucugcuagcucacaaaaagacuggaaacaugaucauuggagcucccggcucuggagaugcagaguagcucagggccggggaguggggagguagcaggauguauucuacggcccagaacugccacagcaaaugcucuuuuugcauuuugaaugaaguaagagggauucuggaauuuucauugauuuagggugguuuauggucaguauugaacugcucagcuucaggaaaccugguucuuucaguacauuguccauugcuacauacguguuuauuuaauucucugcuucugaugauuguagccugaaguauaaugcauuuuuuuccuuugggguuuauuaaacaugacuucuuugcuucauuagaauguagaaauuaguuguuucccuaaaaccuucugaaggaggcagucagcuacuuuucccuuacagaguuaauuuucuucagcugcuaaacuccaugacacucgugaugaguccucaaaucuuaguaaaauuggguacaaagaaucaggaaauauauauaguaaguaacaauuguaccaaaaauuauaaugggccauggaauugcuucauauugaaauuauaaauaaucuguaaugcuauuaauacuagaauaaugguagcgcuucucaucuucagggugccucgugagauuaaccauggugguuaugcuggugacguguuuacauaaaaccugugcuuucugaauguguguugcagucuuaacauucuugaaaucuuugcagaccaguucucaagaugggauaggaaagcuggacucuagguuaccaagugaaaucggcccgacuccuccuguguugagacuagucaucuacuguuccuuccauugagacagaacuguugccuguguuuuuacuaguccuguugaaugcaauggaugguauuuugaauuccuggguuaaaaacagaauugaaaaucugaaaugccuuuacagagcgggcagcuaaaguugcugagcagcaggagagagagcgagcagcacagcaacagcagccgagugcuucuccccgagcaggcaccccugugggggcucucauggggguggugccaccaccaacaccaauggggaugcucaaucagcaguugacaccuguugcagguaaaaacaggagcuaagaccauuuuuuuccacuuuaagaaauuccuucauuuuuuuuuucuccaauaaggaguaggccacagucuauugccuuuucucaugacagauucaaaguuugaagucauccauguuguccuauauugccuuucccauaugggcaaugccucccuucugccccagaaaugggcccugggcccaacccugguaauugguagggagcagcucuucccuggcugugggcauggucuggugauguucuccaccccagccugcucuugauagagcacuauagcagaaaauaugaaaguagacccugaauucuguucuagagggacucccaagagaaaacacaaaacuagucuuuaggugguguugauuuucccaucucauuccaguauucaguuugccuuguucugcugcagccauccuuaaaagacugaccguuuaaaaggauuuuuugacaaugaauuguaaauccuuucuuggucaccaaugugcaugacugcuaaauagaauacaaaguccuuauucaauucauugugcccacucuguaaugcuuuucuauuuaauuacauuaaacugcauuuucuguuaguaucccagucacauauuuaagaaaaaaaaaaagaaaaagaaaaugaugaaugugguuugucuguguguguugucucugguucugguagccauagcaaauuugacuguucuugaauugaauaucuuugucugacaugucuccaaugagaagucugcagaccacuucucgggccccuucuuugagaucucuccaguccuggugaggucuguacaagccaccuguguuucuucuuaagcaagcagucugaccucuuucacagggaguccaaaauaguguuguucaaggcaggcuuguugggaugcuguuuuugcuguuucguuuuugcuuuuuaaggaagaguagcauaggauaacuuuuccauugucgcuccuaacuuuugugauggcaaguucucaaaugcacugucgcugaacucagcaguugcacucgccaaagcacaucugaaucauggcuuucagugcuuucaguguaacugauguugaucuaacaaaucucauaaucgccugcucuauuccauggcccauuuugguuaaugggguuccagagguuuuuagaaaucaggccuugaacauggggacuuugaaaguuagaauucccucguugacauuguguuuuguucuauuugaugugugacguuguggcacugugcccuugacuucaaaacccaggggcacauuaacaaaaugaauacaaacagcuaaaaacaauuaaaaaaaaaaaaaaaacagcagcugcagcauuuuagcucccuguuggggaagaacauuauagaacucuauggaugaggaagguggucccucuagaaagccccugcuccauuauuuagggugugcuggcuagacuucugggcccugggagugaaaagcaagcauucucugcaguaaccacucuuugguccucauggggaacccugcagcuaagagggugauuuuucaugguuuuacagguuucuuagggccugagucuuacuuauuagccuuguugcugucuugagaccagcuuugcuuacaagcauugaagcucauuugaacacaugugacugggauaauaaaugccaaaguacaguuuaaugaagacaagugucaugucuuucaguucuuaauaauuuccucaaccacagcccaugaaggcugcguucagaugggcuuuuguaauugaaagcaaagccucuuaacauccuuaaauuucccgccuacuuaacccuaaaugcuauaacugguggugugguuaaaagauugguagcauuggaucucuucauguuuaauuaagaugauggugucuguucaaaaguaguuuuuacuuucugaacucuucauuuaaaaaaaaaugaaaacucauaaucuuauguauagagagauuauuauucaaauuuuugucauucgguuuauguaauuguaaguuagucagcuuagguaugacuagugaagcagggugaaucgaccucagaauuuuuaguaauuucauagccuuaaaagacuaaacuuuuauaaauaaauauguuugaaaucuucagggaaaguccaagaguaaaauucucagaaucugaaguuuuccacuauuugacagagucccucugcaaagaguauuuuauaaaaaugagguuuggcaccagucccucaacccucccuuugcaagaagcugugaccaaaggugacugcauuuuggggggagcuuuguguucuuauucaucaugaucauuacaaaucccagaaaagucaaguuguuuuucuuguuuuaaaaaaaugccaugugguuuuaaaggucuuuugauaggugaguccuugacauuuugaauuuuuuuucuuacauuuauuccuucugccaaaaauacuuguuugcugaaacucuucucuagccaguagaaaauauuuugucauguguagguacacuuugaaaauaaaggaauaaaagccucuguucacagaaauuguguaccucaaauuaaaaugcucccuguuaagguuuauaugaggacauuugagcuuggagacugauggcauuuggcauuuucucauaucagcagagcccaauucuccagccauuccuccguaaagucuguguguaggcuccugagugaccuggacuugguuggcuugguugggaguguuuagguuuuaucuuuaucacauuuuuagaucuaaagaaggaaauaucauucacugugaugguucuuagaagcuguuccccaacucaagcccaagcacaauccauucuuaccagcagugguaaggcuagaaaggaggaguagauguagaagucuugaacaauuccugccccaaagcuggagaaccaugcuuugugaucaggacuaugcgcucauuucccucccuuccuauuuccccucauguguacccaugauaggcauaugagugugggcagaguggaaugaugggguuuauacuauucaguuagaauugcagucagcagaacuggucacucuguuugaacagcuugcaauaauuauuuccuugggaaggcuguuacuagaacucuuuacuauuauuuaacugaaaacaugcagcauauuuaccccagggaaaauaacuacaaauaauaguguacuaaguacuaauucaucccaaaauguugggucucauauuuguaacuuuuuauuuuguucauuauugcagcaaaauaauugcacuaauugcuguuauaucaugcaguacuaagggugcuuuauucauugguagugcauguggggguugguuguuauuacuuagcucauguugcauguuaaugaugcaugucugaaauuuguuguguccuucaaggcaugauggguggcuauccgccaggccuuccaccuuugcagggcccaguugauggccuuguuagcaugggcagcaugcagccacuucacccuggggggccuccaccccaccaucuuccgccaggugugccuggccucccgggcaucccaccaccggguaagaacuucauccucauucacucauuaaucucaucuucauauucucuuuuuccgcuuucaaccaguuguuccaggaggcacccguggcccauuguggccaggccuucccucccugagaauccaaagguugucagcagcagggcaugucuugugcauucagcagguggcccagcacuugugcccuugugcaccuggcugcuggcagcagcacagcacacauggcagaggccagacucagcaaaccaagggacaagaggcauacucuaucgauaaucacucaacuaauuugacauguccuugaaaagccagacagccuagaaggcuguguccucuuaucagugaaugaaguuucccaaauugcuaguucagaguaacauguaaaagcauuuuuugccccugaguugcauuucucccucuggugcaauucuuaucucacaggguauagaguaucuguuccaucuccuacuucuccucaagcagccuuucuaaggggauugcagagcugcuaagguagaacucuucagaaaucuuucacucagucugucuuagaacaaaaagcagggagggaaugcauuuucacugaauuaguguucuguaugugaguucccuaagaagcaugacaugccagguguaauggcucaugccuguaaucccagcacuuucagagaaugaggaagguggaucacuugagcccaggaguucaagaccagccugggcaaccuggugagaccccaucucuauaaaaauuagccagguguuaggccgggcacgauggcucaugccuguaaucccagcacuuugggaggccgaggugggcggaucacuugaggucaggaguucgagaccagccuggccaauauggugaaacaccgucuuuacuaaaaauacaaaaauuagcugggcgugguggcgggcaccuguagucccagcuacucgagaggcugaggcagaagaaucacuugaaccugggaggcagagguugcagugagccgagauugcaccacuacacuccagccugggcgacagcaagacuccgugucaaaaaaaaaaaaaaaaaaggaaaaauuagccaggugugguggcaugugccuguagucccagcuacucaggaggcugaggugggagaauuaccugagccuggggagacugaggcugcagugaguggugaucgcaccacugcacuccagccugagcgacagaaugagauccugucucaaaaaaaaaaaaaaaaaagccugacauuaaagaacagccuagccuacccuccuagcuguagauacugguuugucugucaacagaagcuuagaaguucuuuuauauagaaauauauaaauggauuccagaaauagcgacauucauuuucacuuuaaaaugugaauuagcaaguugaaagauuauuuuaaagaaaaccuaaaugaaaggaaaaucacauguucccauauuaauugccaucauaugcaaaagaacucuuagcuguaaucuggauggagggaaugugaccuuuggaagacucggaaagcauuugguccauuaccuacaacaucagcuaagggcccaacccaaaugguaaaaugugguuggaaacuuguuaaauuugcuuguaccaguguuggaccuaccagugauaggguuuugcaggguaccaaaugaugcuuuggagggugcacccagcagugugcagagugagcaaacuugguggccuggccuggagccuccagccacacucuuugugagaguugcuuagaauauggccauaauuccacagaagcauuugcuccagguauugccagaggaggaaguguuuguaggguuaggugcuucauaugaaaacaguggacugugugaauugcuguugcagcaggagucagucauaagguaaauguucccauguggcagguagacuuggccuuaauuuuuugcccucucaccuugauacaggguaucacugagccaauaagaccaggcuggaguuuacaccuucuaggugcacuuagugggauccaugucuaaugccaguacccucuagguugcagaugucuuuugguggguguugggacauagcugucuuccuuuccaccuuccugaaauccuaaauucaacuggagggaagcccaacacaccugcuuagaauugaggagacagggccggacacagugacucaauccuguaaucccagcacuuugugaggcugaggugggaggauugcuuugagcucagcaguucaagaccagugggcaacauggugaaaccccauaucuauuuuauuuaauuaaaaaagaagccaggagucagggaagacccccucuuagugccuacaaaugcacaugucugagcaggcuuagaggaguaggggauucauugagcucuuuuggugacucagcucagauucucaccggcugcccaaguauggcauuugucaauagaggaagcagaagaguuugcugauuugugcugcccugcaaagcaaugauuuacacaguuuagggagccacaccguguucuggaaucuaaggugggugagugucccagggcacagggaggugaugggcacagagguuaauaauauauugcuggggcaccagcuuacccaccacaaccucuucauucauucacgaauaaucaucaggauccuacuuuggugauccggguggacuucuggguacuuggaauauaaaacucccugcuuuuuaaacagaagcuuuuuuacuuguuauuuucuaacaaauaagaggcucucuuaugcuuccuggaaguggcauuuaacaauucugaaccuuagugcucgcuucagcagcacauacacuaaaauuggaacaauauggaguugagcauggcacaaggaugacaugcaaauucaugaaacaguucugaacuuuagaaugaggagcugcuucugccuggacaaaauauuacgauuuuuaauccgaagggacuauacacuaugaaguuauaccuccucucgauucuucuacacagccagcaggauuuguuuaaguuuucaagaacaguucaccacaguuuuagguuuauuugauuuuaaugaacugggucccuugccuauuucuguauuuuaucagaauagcaaauaugcacccugaaaucaaaagagccucugacacuaaauuuaggacaucucauuauuaucagcugugccugugagacaacaauugcucgugagcauucacugagggaagcuuacaaaauuauuaucagggacauaguacaaaucuaguagggccaugaagucucucuguuccuuugucauuuugcauauaaagcaauagcaacaagguuacuucacuucagaugauuccuuuucagagugcuacucuaucagauggaaguguucucucccugccagcacuagugacuccaguuagaaccagcugcugauggucugggaggggauagcaaggcugugccuucagccuucacaaagcucauuuaacuaugcacuuccacagccucuucccuugugucccugcuguccuagcacauugcuuacugcugagccugauuccagugccauuccugcuuaaauuaaauacaggcuucaguugcaggagaauguguugucagaagaaaaacaccuugaauguagagguauauucugacaauagcuuaccuagagaaauacuagaauuuuaugcaagguucaaaucauuucuaagccauaauugauguacaucugacagauuguucuaguauuauacuuuaaguaccuagaaacaaaacaacuuucuauucaaauccuauuggggugcuuaagauuccuagccacaaagauucaagggcagagguacauagguuugaauuaugaauggcaucauuucuuaucagacaguaguuuuucagucauuucaacccagagccucuaacugugccauugcauucugaauuauaggugugaugaaccaaggaguggccccuaugguagggacuccagcaccagguggaaguccauauggacaacaggugagccucccaguuugauuuucuaggacuugacagaauucgaguuauccuucucagaacaugugcagagucucuuuuugccucaccaugugguccugugcucuuucaggugggaguuuuggggccuccagggcagcaggcaccaccuccauaucccggcccacauccagcuggacccccugucauacagcagccaacaacacccauguuuguagcucccccaccaaagacccagcggcuucuucacucagaggccuaccugaaauacauugaaggacucagugcggaguccaacagcauuagcaagugggaucagacacuggcagguaagauuccuucuaaauaagccuuugugaaauacaugcuuccucaaagcugucuuacugcuguuagcauaguauaucauacaauaaacaccccuuuuucuuauacaauuaaaauaaauuauauauuucauaaaugguuuggaguuucuuugcauguuuacguaacacacugaaaaugguuuguuuuguuuuguuuuguuuuugagacagggucucacucuguugccuaggcuggagugcaguggcgcgaucuuggcucacugcagucuccgccuuccagguucaacugauucuucugccucagccuccccaguagcugggauuacaggcacaugccaccacaccuggcuaauguuuauauuuuuaguagagaugggguuucaccauaucagccaggcuggucucaaacucuugaccucaagugauccaccugccucggccucucaaagugcugggauuacaggcgugagccacugugccuggccugaaaaugguuuuuggguuguuuuuuuuuuuuugagacagucucacucugucgcccaggcuggagugcagugguacaaucucgacuuacugcaaccuccgacccccagguucaagcgauucuugugucuuagccuccugagcagcuggaauuacaggugcucagcaccacgcccagcuaauuuuuuuaucuuuaguagagaugggguuucgccguuuuggccaggcuggucucgaacuccugaccucaggugaucuauucaccucagccucccaaagagcugggauuauaggcaugagucacagcgcccugccuaaaaguguuguugugguuuuuuuugccaaauuucaaagccuaguuuucucauaaacaucacugccaucuuuuuaaguacauuguuuuuuguuuguuguuuuguuuuguuuuguuuuguuuuucaggcauuuggacauuaguauagaugcauuggguaaauuaaaaauuauuggccaggcacgguggcucccacuuugggaggcugaaguggacagaucgauugaguucaggaguuugagaccagccuggacaacauggcaaaaccccgucucuacaaaaaaauuaaaaauuagccagaugagggccaggagcgguggcucacgccuguaaucccagcacuuugggaggcugaagcgggcagaucacuugaggucaggagaucaagaccauccuggccaacauggugaaaucccaucucuacuaaaaauacaaaaauuagcugggcguggugucuggugucuguaaucccagcuacuugggaggcugaggcacgagaaucauuugaacccggagguggagguugcagugagccaagaucgcaccacugcacuccagccugggugacagaauaagacucugucuaaaaaaaaaaaaaaaacuauuuuaccucaguuuaacaaaaggaaaaaaauauuagaaaccgauuaggcuauucauuuaguucaacauacuuauguauuuucaguauguacuaaaguacuuguguaguuucuggagagaaguuuggaaguuucuacuuguucuugauuucuaaaccaacuuuggucaucucauuucauuucuuuagaguagaagguauauuuucccuuucuucacauguuuaccuuuuuaggaauuuuuguuaacauugaaguaauuauuaaauaucagggaugccuacaaaaaaauaaugaucaggccgggugcaguggcucacaccuguaaucccagcacuuugggaggccaagguaggcagaucaccugaggucaggaguucaagaccagccuggccaacauggugaaaccugucucuacuaaaaauagaaaaaucagccaggcuugguggcagauuccuguaaucccagcuacucuggagccugaggcaggagaaucgcuugaacccaggagguagagguugcagugagcugagaucgcgccacugcacuccagcgagggcgacagagcgagacucgaugucaaaaaaaaaaaaaaauuuaugaucaaaucuuuuagugccuaguaaaaugauauaagaaaugugccuggaaauauucugcaguuaaaauucauaauauuuaauaaauauucaauguuuuguguuuuaauaaguucgucagaccuuagaacugagggaaauuuugccaacuuaaaauucuaauuucugucucucuguacuuuaauuuucagcucgaagacgcgacguccauuugucgaaagaacaggagagccgccuacccucucacuggcugaaaagcaaaggggcccacaccaccauggcagaugcccucuggcgccuucgagauuugaugcuccgggacacccucaacauucgccaagcauacaaccuagaaaauguuuaaucacaucauuacguuucuuuuauauagaagcauaaagaguuguggaucaguagccauuuuaguuacuggggguggggggaaggaacaaaggaggauaauuuuuauugcauuuuacuguacaucacaaggccauuuuuauauacggacacuuuuaauaagcuauuucaauuuguuuguuauauuaaguugacuuuaucaaauacacaaagauuuuuuugcauauguuuccuucguuuaaaaccaguuucauaauugguuguauauguagacuuggaguuuuaucuuuuuacuuguugccauggaacugaaaccauuagagguuuuugucuuggcuugggguuuuuguuuucuugguuuuggguuuuuuuauauauauauauaaaagaacaaaaugaaaaaaaacacacacacacaagaguuuacagauuaguuuaaauugauaaugaaaugugaaguuuguccuaguuuacaucuuagagaggggaguauacuuguguuuguuucaugugccugaauaucuuaagccacuuucugcaaaagcuguuucuuacagaugaagugcuuucuuugaaaggugguuauuuagguuuuagauguuuaauagacacagcacauuugcucuauuaacucagaggcucacuacagaaauauguaaucagugcugugcaucugucugcagcuaauguaccuccuggacaccaggaggggaaaaagcacuuuuucaauugugcugaguuagacaucugugaguuagacuauggugucagugauuuuugcagaacacgugcacaacccugagguauguuuaaucuaggcagguacguuuaaggauauuuugaucuauuuauaaugaauucacaauuuaugccuauaaauuucagaugauuuaaaauuuuaaaccuguuacauugaaaaacauugaaguucgucuugaagaaagcauuaagguaugcauggaggugauuuauuuuuaaacauaacaccuaaccuaacauggguaagagaguauggaacuagauaugagcuguauaagaagcauaauugugaacaaguagauugauugccuucauauacaaguauguuuuaguauuccuuauuuccuuauuaucagauguauuuuuucuuuuaaguuucaauguuguuauaauucucaaccagaaauuuaauacuuucuaaaauauuuuuuaaauuuagcuugugcuuuugaauuacaggagaagggaaucauaauuuaauaaaacgcuuacuagaaagaccauuacagaucccaaacacuuggguuuggugacccugucuuucuuauaugacccuacaauaaacauuugaaggcagcauaggauggcagacaguaggaacauuguuucacuuggcggcauguuuuugaaaccugcuuuauaguaacugggugauugccauugugguagagcuuccacugcuguuuauaaucugagagaguuaaucucagaggaugcuuuuuuccuuuuaaucugcuaugaaucaguacccagauguuuaauuacuguacuuauuaaaucaugagggcaaaagaguguagaauggaaaaaagucucuuguaucuagauacuuuaaauaugggaggcccuuuaacuuaauugccuuuagucaaccacuggauuugaauuugcaucaaguauuuuaaauaauauugaauuuaaaaaaauguauugcaguagugugucaguaccuuauuguuaaagugagucagauaaaucuucaauuccuggcuauuugggcaauugaaucaucauggacuguauaaugcaaucagauuauuuuguuucuagacauccuugaauuacaccaaagaacaugaaauuuaguugugguuaaauuauuuauuuauuucaugcauucauuuuauuucccuuaaggucuggaugagacuucuuuggggagccucuaaaaaaauuuuucacugggggccacgugggucauuagaagccagagcucuccuccaggcuccuucccagugccuagaggugcuauaggaaacauagauccagccaggggcuucccuaaagcagugcagcaccggcccagggcaucacuagacaggcccuaauuaaguuuuuuuuaaaaagccuguguauuuauuuuagaaucauguuuuucuguauauuaacuugggggauaucguuaauauuuaggauauaagauuugaggucagccaucuucaaaaaagaaaaaaaaauugacucaagaaaguacaaguaaacuauacaccuuuuuuucauaaguuuuaggaacuguaguaauguggcuuagaaaguauaauggccuaaauguuuucaaaauguaaguuccuguggagaagaauuguuuauauugcaaacggggggacugaggggaaccuguagguuuaaaacaguauguuugucagccaacugauuuaaaaggccuuuaacuguuuugguuguuguuuuuuuuuuaagccacucuccccuuccuaugaggaagaauugagaggggcaccuauuucuguaaaauccccaaauugguguugaugauuuugagcuugaauguuuucauaccugauuaaaacuugguuuauucuaauuucuguaucauaucaucugagguuuacgugguaacuagucuuauaacauguauguaucuuuuuuuuguuguucaucuaaagcuuuuuaauccaaauaaauacagaguuugcaaagugauuuggauuaaccagg

SEQ ID NO: 193038 - RNA, 168550 nt, Homo sapiens
gcggccgcugcagagauuggaauccgccugccgggcuuggcgaaggagaagggaggaggcaggagcgaggagggaggagggccaagggcgggcaggaaggcuuaggcucggcgcguccguccgcgcgcggcgaagaucgcacggcccgaucgaggggcgaccgggucggggccgcugcacgccaagggcgaaggccgauucgggccccacuucgccccggcggcucgccgcgcccacccgcuccgcgccgagggcuggaggaugcguucccugggguccgggugaguugggagugcgcgugcggaccggaggggcuggccgcagcggggaggccagaggggcucgggcgaggcugcagaggcagcugggcgcgcgguggccggagccaggggcugcccggcccggccccggcagcuccgcaggccucggcgcgcgcugggccgggaccgcccagccagagacccacggcaccccgcgccgcgucccccgccggccccucuuuugucucccacucgcggguugcaggccgaguuuggggaugcggagugggcgaaagucgcuccggggacgcuucuggaauccuuaaaugggaaaggcgcucaccuccccgccccggagcggcgaggcugauauuugugauuuggcuccggacgcuguggggaggaacaggggagaacaaaaugaguuucgggcgggggucgagugagaggagcagccggcccgcccccgaguccccgcgggaaggggcccuggcccccgagcucccggagcugcuucaccuguuguccugcgcggccuccgcuccguggccuggugauuccguacuucaguuuuggaaaacuuucugcuggauugccuggacccuuuuuucucuuuccagacuccuaguggaaagauuuggcaaggaaaaaaaaaugagcuugcgucagggaagaaaaauaauaugcuguguguuagggucuggcguuugagcgugguacucuuucaugcucucagauguuuuaauuuggucaaacuccugcagguuuucucuuuuaagcgguuaacaaacuguucagaguacauaguaugaacuuggcaccuguguuacgucauuuaauccuuacaacgauucugguuuauuguauuccucauuguuuuaggggaagaaaccgagucgcaaagagguuaacuaacuugucuaagggagcugggauuugaacccaggaacaucguauucuggcaaacgaauuaggaagaaaaaaaaccaaaacuguuugcaaacacuuuuacguuuaggaacauuuuucaguuacucuuacuugaaauuaucgcuauuuuguugcuggaguugaaaacaacuacuuuauuguauuuacuugugagaggaguuaaacuuugaauuagaguguaacuuaaugcgucucauuguuuucaguuguugaaauaaagaaugugaaccagaauuauuuagauuuuuaaauuugaagcuaaaauaugggcaauucucugaucuaggaauggggugaguguaugaaaggccgauugaaauguagaaugcguuuuuaguagaaccagacucaguucuuguuuaauuuuuccuccauuuuccguggagcccacuuuaaacuuuuucuacuuucuucacuucuccccacccuuuacagaagagguugaggcacuuagcaggagcuccuucauuaaauuccuucuguuacuggcuucuuaaccuuccgucaaagagggagaauuuuuuuuuuuuuuuuugucuuucuuauuaguuaacaccuugggguuuuuuuccuuuccuucuaauuuuccugcuuaguggagcgugaguuauuuucucugucguauuuggguucuuuaaaguacaaauguucuuaagauuuuuucaguuuacaaaaaccuuuucuuaagucugcuacuccuucaagcugucuuguugcugcuuuuccuuuucaaaucuuauuaacauuuuaaaaagcuuguucguaauaaaaguaacacaugguuguuaauugcgaacuagcgcaacauugaaauuaaaauuuagucauucacaauccaucucuagagauugccaaguguagucugcuuuuccugccuuugccugguugguggcuagccacucauuucuuaaccccuuguuaucuggauuucaccuucacaaggaacuauaaccuaaucaacacauuuaacuaccuuuuucuaaguccucuccuugaguuuucuguaagauuuaacaucgacuucacauuuucagaugccucuccuuggguuucauucaucuauacucgcuguauucuaacacaggguccaaggcaguaagauacaacagauccuucccucauggagcuuaaagucuaguggggaaauacuuauugaaaaauaaagucucuaguuaaauauaauugugauuuuaauuaaggugcagaauauuauaagaacuucaaauggagaccugaucuggugcuugugguggugggagaaucugggaaagauaccuuaaaauugcuuuguuggaacccaggcagauugugaaggaugagcaagaguuaacuauuaacuagaugaagaggggccuuuugugacauuauacugacuuuguuccucuccgccacuuuucugccuucuguuucuucuuuccucuuuaauaugcguucuccaaguuucacuuuucagaucacuuuucucuaugucucuagucccuuagaaugauuguucagaccuuucuguuggaauaauucucaauucuuuguuuaugugucuucugaaucacguuuuuuuguuuguuuguuuuguuuuuucuuuuuuauucaguugcuuucuacauaucuguaccugauuguucugagcugcuuuuccuuagcaaacuugccucuuugguguucuuuauuuuuguugaugucauaccaaacccaaaccuuuucccauuucaucauaucuugucuguagccaacaucuguugauucugcuuuaugauauuguaacucuucugcucucuauucuugcuaacuguggggcaauucugaauucauauuggugugaagguaguagucaaaucauaaaacgaguugggcagcuuuccuucuuuuucucuuuuucaggaucauuuuagacugggauuaucuguuccuugaaaguuuggaagaccuccccuaugugaccauuuaggccuagaucuuuuuucuggagaggacuuugaguaacacuucaauuucuuuaauagcuguugguuugugucgauuuucugauucucauaugaauuuuaauguuucacauuuuuuucaggaauuuauuuucaaaucuaguguuauuuggcuuucacguaguucuccccccaccaccccgcgacuccacccccacccccuaacucuaaaucaaguucucaucccaccuggacuaauguuaugauuuucuugccuucacuuuucuccuuuaucuaaucuuauguauuucugccuaaauuaaucuguaagcccaguucuuaccacuucgccacucagaaguuuccuaggucuuccauuaaaugaaauauuuucugugguauuugccucagauuuaccuguuuuuuuuuuuuuuuuuuuuuaauaccuuauuguuuuuucuuucuuucuuucuuucuuucuuuuuuuuuuuuuuuuuuuuuuugauacagagucucgcacugucgccugggcuggagugcaauggcgugagcucagcucauugcaaccucugccuccuggguucaagggauucuccugccucagccucccagguagcugggaccacgccuggcuaauuuuuguauuuuuaguagaggugggguuuugccauguuggccaggcuggucuuaaacuccugaccucaguugauccgcucgccucagccucccugugcugggguuacacaggugaggcacuguggcuggccuuuauagcaguuuuuauacaaauauuaguuucacuacuaguuugcagggugggucuguaacggacuuuucuugcauauuaaaaggaauaaauggggaaaggcuccugucuagccuaacaguagcuguugaacuguccugaucugacuauuggaucuuaggagcagcgaaccauggagagaaaggaaaauggguuuccuaucacacuaaauuuugaaguaggaaccauuucuuuuccuuuucuacuuucccaccuuuuacuaguuuuuaggcuuuaggaugucuuuuuaacaucacaagguccauauugaccaaguuggaccaacuuuuuaacacaagauuaaauguugacuugcauugaguuauguccauuguaagauacacaguaguguuacagaccacuuaaaauaugcuucuaguuguaagaagccauugauuguaaggugcaccccaauuccggagaugcuaaaauaugaaaaauggaugcaucuuagaauugaugaauaguguuucucucccuaaucaaagcucuuggaugugccuggaaauccccaguaguguuuuuugaaaagaacacuaguuaggggcauagggagaucagaugaucaguagacuccaucucaggguggccccuguggucccuaagccaguucguaugggcaguuuaauauauaacuaaugaguagacauugaauagaugaguaaauuaucuuugaguaucuuuuauuuacucugauguuguagacuuuguuacucuuuuauaguuuuauauuucugaugagccuuccuuucuuauggcacagauuuguuauacuguuaaagucuggaacaguggagcuuggcucuugauccagcuguauauaauuggcuguugacuuaugaaggaggacaggaguaugcuagagauagggauaaaauauuauaaucacauuugcaguuagggagauuaguuacauguuggaaaaucauuuugaagaaaggaagacugaagauguucaaacuuguaggaaggucuuucuggccuagcccggauuaaacccauuuaugccuaguguuccacuauuggaacgcuaagcacgugggaguuauuuauauccugcucaaggucaucaccaaggucugauugcaaaaauucaaaaaauugcagccucaggcauaaauggguuaagaugguggcagauaauuagggccuggaauggauaggaggcgauaacuagcguggaugagagaaggaaugggauuggcaagaacaacuccuggauuucuagcuuggaaagcaggguagaugugggugacagauaugaaaaaugaggugggagagcugguuuguagaagaaaauaguauuggaucacauggaguuugagauaucugaaacagccaaguagggauuuccacuuggcaguugucuauaugggucugggguuugacagagguuugugcuggagguaggcauuugggagucauugcuguauagauuuuauauuccaacagugggaauuggguggcucucucaagugacucuugcuuacaagugacagcccuaacucaaguuagcuuaaaggagggaaaagcuucuccccacuaacccccaugauauugaaaggucuagaaauagacauggcuggaccuaagugcucaaaugauauaauuaauugagguugucuuuucuguucuucacuuuuguggucucauuucaggcaggugcauauaucuggcagaggaagacauagguuauagguuauagaauuacagguuauagguuauagaccucguaucgagaacuccuuguauggucuagcaaagagccuaaaacagcauugagaauuuuuuuucuuucuuuuugagacggagucuugcuauguuucccaggcuggagugcaguggugcgaucugggcucacugcaaccuccgccuccuggguucaagugauuauccuggcucagcuucccgaguagcuggguuuaacaggcgcccgccaauacgccuggcuccuuuuuguauuuuuaguagagacaggguuuugccucgugggccaggcuggucucaacuccugaccucaggugauccuuccgccuuggccucccaaaguucugggauuacaggugugagccacugcgccuggccagucuugagaaauuucaacuuaaggccuggguagagaagauagacauuaaauaauuaucuaguuguaguuauguuaagaucuacaaaaaggaaguccagggaauguuacaagacugauaagggaagcugggcuguucaggaugcggguacuuuggaaggcuuuccugagaaagguagcccgcagagugagaccuuaggcaagaaaggacaaggagacuguuuuuggaaguauucaguaguauuuauuuauuuauuugagacggagucucacucugucgcccaggcuggagugcaguggcgugaucuuggcucacugcaaccucuaccucccggguuaagcgauucucaugccucagccucccaaguaguuggggucacaagcgugagccaccacgccuggcuaauuuuuguauuuuuaguagagacgggguuucgcuguguuggucaggcugaucucgaacuccugaccucgugauccgcccaccucggccucccaaagugcugggauuacaggcaugagccacugcgcccggccagaaguauucgguaaagugagcaguuuuugcagcuuuuuaaaaauuuuaaaggcaauacaucuauuguggguaauuugggaaguauaaaaagccauaaagaagcagcggaaugauuaaguuucagcuucuaauuuuuuauaaauaaugucugauacugguuuuacuacugaguaccuauucaaucacggaugccacacuaacccaauccgaaucuucguuucuuuaucuuaaaaaauagaaggaacauggugaacuuuaagauaauuuuucugcuuaaaaaaagaaaaagaaagaaaauaucuugacuugcagcacaguuagcugccgaaauugaaggucauauaaugcuuuugguccuaaugacaucacuggacuucugacuuuuggcugaagaaucacgccagccuuggcaguccuugcaaguaccaaagggaguauggcuuaugccugcggugcccuucccguauccugcuuucuuaccuccuuuuuugagcauuaauuuuuuuuucuuuagccuuuggguaaaguaucaaaauguugagaagauagacucucaauuuugaaggugagaaaucuguaggagacuuggauaguuguuuuuuuuuuuuuuuuuuugagacggagucucgcucugucgcccaggcuggagugcaguggcgcauguuggcucacugcaagcucugccucccggguucacgccauucuccugccucagccuccugaguagcugggaccacaggagcccgccaccacgccuagcuaauuuuuucuauuuuuuaguagagacaggguuucaccguguuagccaggauggucucaaucuccugaccucgugauccucccgccucagccucccaaagugcugggauuacaggcgugagccaccacaucuggcugacuuggauaguuuugauacuguuuuauguauauuaagauuuguagguaguuuucuuacuaguaauuaaaaugcuuuguaauguauuucaagaguauagggucuugaguguuuuaaauuuguauauaagaauguuuuagauuccuggcuaaaagaagcucuuguuagaaaauauuaaaguaaaggcuguuaaauuuuggugaggcucuuaaugucugcauuuuucaagaaucauuuaaaaaugucaugaaauaaaaauauuucagugguaacuguucagaaguaucuuaaauguauaccaaaucaaugaaauauaaucgcugggugacagauuauucuuccuucauuuuauaaucuuuuauuuaauaaaaaugugggggaaaaauugcauguugaaguuguacguguauauuuuagcaaaaacuguuaaucuuucugaaguacugcuuuggucaucaucccuauuuguuaaauauuuuucccuguuuucuuauuugcuuacaauagaaaauccagaauaucuuggacuggucuccugcucuggccaagucagccuuuucugcuuugcuuccuuuccuacuauuuuaucagccuaagucacguaaauauccgauucagguuuggguucagaauccuuagaccucuacuguccacuacaauagauagccacuaccacauguggcuguugaagacuugaacuguggcuagucuaagugugaauuacguaccagauuuugaagauaguaccaaaagauguaaaauaucucauuaugcuuuuaaaauauugguuauauagugagaugauacuguuagggauacauuggauuaaagaaauauauuaaaacugauuuuggccgggcaugguggcucaugccuguaaucccagcacugugggaggauugcuugagcccagcagcuugagaccagccuggguaacguggugagaccuugucucaguuaaaaaaacaaaacugauuucacaggauucuuuuuacuuuuuaaauguggcaacuagaaaguuuaaaauuacacgucauauuggacaguacugccuuugacuuuccuuucccugguucuuugcccaucagaaugcuuuaaaaucuaguauaaauccuuggccaggugcuguggcucacgccuguaaucccagcacuuugggaggccgaggcgggaggaucacgaggucaggaacucgagaccagccugaccaacauggugaaaccccaucuccacuaaaaauacaaaaauuagccgggugugguggcacgccuguaaucccagguacucaggaggcuaagacaggagaaucacuugaaccugggagguggagguugcagugagccgagauugcaccauugcacuccagccugggcgacagaguaagacucugucucaaaaaaaaaaaaaaaaaaaaaagaauauuccucucucuccuaugaagcccuccucagugguccaagccucauaguuggcucuuugcugcaucauuauuugaagauaaucuuuugguauauuagauuucuuuacuacaaaccuucucagaacuuuuaauaugcuaauacacauggugaaacucuaguauaguuucccuaacuacguauuaccauagaacuguguguuuucuguuaacagaaguuacacauauuugugguugaaauuucaaacaauacagaaaugaaguaaugaaagucuucuguaaucaugcuucaccugugccccaagauugccacuguugaaaguauagagcuagaaaaaauuuucuuuucuguugccuucuuucuuuuuuucuguccccauuuccuaaaauggggucauacgauacauccuuaucuuuaaauuuauuuucacugaauauauagggggauucuuuuuaugucaguaaauuucaauuuccucauucuuuuuuuuuuuuuugagggaaggucuuguucuguugcccaggcugcaguggugcuguggugcaaacagcucacugcagcauccaacuccugggcucaagcaauccucccaucucagccuccugaauagcugggaccagaggugcaugcuaccaugcccagcuaauuaaaaaauuuuuguguguguggaggugggaucucaccaugaugccuaggcuggucucgaacuccugggcuaaagugauccucccaccuaggccucccaaagugcugagauuacaggugugagguguugugcgcagccuuaaucaucucauucuuuauaguaguuaagcaguuauuccauuuucugauuauaccuuaauuuuacuuaccaguuucguguuaaugaauaauuagauuauuuccauuuuuuucuuuugcauugcaaauaugcugugguguuuguacauauccuuugagacuguuuuuauuuuaugaaaugaauucuuagaaaugcauuuacuauaagagaagccgugcagauuggauggaaagugccaagccacccugcaaaaucuucguaaccauucauauuccagccaacaguauuugaauauguucucuccucccaacauaaucauaucagucuuuuuuuuuuuuuuuugagacggagucucgcucuuucacccaggcgggagugcaguggcgcuaucucugcucacagcaagcuccgccuccuggguucaugccauucuccugccucagccucccgaguacaggcgcccgccaucacaccuggcuaauuuuuuuuuguauuuuuaguggagacgggguuucaccguguuagccaggaugguuuuuuuuuuuuuuuuggagaccgagucuugcucugcugccaggcuggagugcaguggugccauccuggcucacugcagccucugccucccggauucaagugauucuccugacucagccuccggaguagcucagacaacaggugcacgucaccauguccagcuaauuuuuguauuuuuaguagagacaggguuucaccauguuggucaggauggucuugaucucgugaccucgugauccgcccgccuuggccucccaaagugcugggauuacaggcgugaggcaccacgcccggccauaucagucuguuuuuaucuuugccaguuugccagcugaaaaaacauucaugauauaagguuucuuugcuguuguaugaauauuaaaaaacaaaaaauuuuaaguuucauuugucuuauacucucaacuuguuauacgcuccuuugauuuuugugcuaaaauauuucguauugcuaacaguacacaugcaugcuuuguacaaaguaaauguucagauauuuguaucuguucauggcaaaggcguccagaauaugcuacugcaacauaaaaauuauuuggaaaccugguggcucaugcuuguaaucccagcacuuuggguggcggaggcaggaggaucacuugagccuaggagcucuagaccagccugggcaauauguugagacucugucucuacaaaaauuuaaaaaucaaugagauguggugguaugcacuuguagucucagcaacucaggaagcugagguggggggaucgcuugagcccaggaguucgagacugcagugagccaugaucuuacacugcacuccagccugagugacaaagcaagacccugucucaaacaaacaaaacauauauuuuaaucuggaaacauuugagaauagcuuuuuuuuccuccugaacucccuugucugccuaaaacuagauccucccccaaagaacucaauugucauaacuuccaguugucauaaaucccuuccuugggaguuuugcaagcagggaagauggucucuugucgcuggagagaauuuggcaccacaccuaaacagacauuguuauaaacuauccuauguccaacuguuguccuaaggguccauuugucuuuccuacauguuacuuguuuuccugcaacagcccauuguucuuuucuaguuccaguuccccuaguaagaugguacacaugccccaaauucggacagcccccuugggucacauuuuucugugaauuauucuacauaugugaaucaaaucugucauuucucuugcagauguguucuuugucaguuuaauuuaucagaccucaauuacugaaccuaagaggguguaggaaguuuuucuucucugacaauggccaaauugauauuuuucuggcuguaagggcaagggauaauaauaaaguaacguuuuucuaagaauaaauauaaauaucuuaaauauaaagagcgugaguaaaguuucuuuaaaguacauuaaaaaaacuguuauccaaaaugaaacauuuguuaaaagaaguggauuaugcuauuaaagaugugccccccacccccauguguuuguuccuaucguaguaaugcugauuguuaauggauggcauaguaacuuuaauuguguucacaggccuuuguucuuaaaauuaugcacucuucccuguuuuuucuuagcauuuuaucaauuugcauagaagagaaaaugauuuguaacagguuucucuggucacaucacugaggagagucaacaaaagaagucauucaauugagguuaaaucuuuacacaaagaaggcauuaauagcuuaaaagaauaaagaaauccugauaugguuauugugacuuuuccauuuaucugguuaugaaauaacuaaaaagguuaauuaaauguuggcuuauuucuagguuuaguuaugcaucgguguguuuauugcuuucugugccuuauuacacucugcuuacuagguuugugaccuugagccaaaguuguuaauuacucuaagccuucuuuucucauaugugaaacaaggauaauaaugguccucucucucagggcuacugugaggacuaaaugaaugaugagugcaguucagugcuuaacacugugcuugccacuguaguagcuuaaugaauguuagugaagaugaguauuucugagagaaauaagcaggacaguucuaucuuaaaaugcagguuugaauggcuucacauacaggguccuugaaaauuaaaucugaucuuguugcuuucuaaaaguaugcauuauuuuagcuuccauguuaauauucacauuugaauuugcaaaaugcuucuguguaucaucaguacuggcaaauugauauaggaaauuuuguugcuuuuccugcuuuguacaucaagaauuggaggcuaaugaagguuaauuuucccaccaaugucaaacaaguugguguaaaagaguaaauagaucuagagcugaacucuguaguucuaccuacuagggaggcugaggugagaggaucacuugaggccaggauuuugcagcuguaaugcauuaugagaauaaugugcuauguaaauagcaacugcgcuucagcguggacaacauagcgagacccugucucuaaaaagaaaaaaguaaauagaaucagacuuuuccucauucacucagaguggaugauuaggaccucaaaguuacauauaaaguaaagucaaagacuccacaugcuaaagaaagcccuaggcauuaguggccagaauccuuuccagggcuuauuaagauguggcagaauuaggucacaaguuggggggagaaggaauugugccagaauugucauugcagcuauuaguuugccuagcagggagcacuguaguuuuucuucccuucuccuucccuuggaguguccuucccuuagaaacuuaguguggagaggucuaagagaaccauuccuggagguuaagaauacuagcagaagauggaauggaguaucugauuaccuaggcaguauuaauuacgcagcaggcugguuuaucuguaccuauuugagcaaaggauaaggaaaauuagaaaucccaguguggauggagggguggcagugaccuucuuuuaguucagguggguaaugcagauguaaccaggcaccagccuucuugccaggcaggcugugcuggacaggggagcaaaaguaguuggaagagggugagcugaggcugggcaaggugaugcagaccuauaaucgcaguacuuugggaggccgaggugggaggaucauugagcucaggaguucgagaucagccugggcaacauggcgaaaccccgucucuacaaaaaguauaaaaauuagcuaggcgugguggcgggcgccuguggucccagcugcucaggaggcugagguggcagauuggcuugagcccaggagguugaggcuacagugagcugagaucgugcuacugcacaucagccuaagugacagugaggcccugugucauauucccagcuucuugggcaacugaggcaggaggacugccugagcccagaagguugaggcugcagugagcuaugaucuuaucacugcacuucagucugcgagagagagacccugucucaaaaccaaacaaaacaauacaacaaauggagggugagcugaagcagaucuucaggugggcugagagccucuagucuccuuugucaugaaagaaccccacuuguccccagaagaaaagcuaucauuugucugcuugugauacagacaguguagucaguauuagccaggaaaguggcaacugagauagcuacuccagucucucuccucccuccccuauucaucagaccacaccccuuccuccaggcuagcucucuuggacugggugcacccaaucugaauuugaagagaaaggaggugauuguaagacugaagauuaacguuuuaaacuguacuuuuuaauaaccaaaagcuauaggaacuuuucaagaucuccauaagaaguggaaaagggagauuugaccaaccacaauuagggauagggauagagaaacaauuguuucuuguguuuguaccgauuucagacccuuuguuaagagccuuaaguucccauuaccuuaaguucccauuaaggccuuuggacacauuaaguucccauuaaguucccaccaaggccuuuggacaccaaaucccauucucuuuuucuccguaugaggcugucacaguacuauagaugaccauuugaucuucucaguggccuguuuccaaaugcauucugauucucaauacuauuuuagcauuaaguguaucauuuaauuuuaucucagauuuauaagcuguauauuauaugauaacccuuuuaauuggaauauuaauucaaauaucuuaauuccuuuuuauggaauuguuggaguuuaucaaaccuuggaaacguuaaauaacauaaaaagcacucaaaaagaaacacuaauucaauauuuuauuuuuacuuaguguuugagauuuugaauuuuagaaaguuuuaaauuaauauucagcuguuauucacauauaaaagguaaguagguuuuaguuuaaagaauguugagcaauaaaauauaagauugagauggauuaaaugguaucugacauauuuccuuacucugaaucgauuuaaccuuuacaaguauucuaugauauaguuacuauuaucaguucccuuuuacaugaggaaacuaaggcugcagagguuaaguagcuugucaaggguugcauaguuccuaaguggcagagcugggauucaaacccaggcagucuggauuuuagaguccaugcucuuaaccacauaauuauauugucaaauggaggaggagaauuuuaagaugaggauguguacuaggcacagaguugacuuuuaacaauuaaccucucuuuuaauauuuaaaacgugguagagauuuuccacauuuaaauuuuccacaguuaaucuuugagauugauugauugauugauugaagcagggucucacgcauuccauuccccaggcaggagugcaguggugugaacauggcucacuguagccucggcugccugggcucaagcuuagauccucccgccuugaccucccaaagugcugggauuacagcugugagccacugugccuggcuccaauuuauacuuuuuuacuuuacugauuuuguuuuuccuuugcaucuuaaacaauauuaaaaggucaguggcauauaguuguuuaaaaaaauauuuauccaaaauucuucccacauaccuucuuuaaaaauuagugcuuuuuuuuuucucaucucugagauguauacauguuuaauuggcgauggucagagauagguuuuuuuuuuuuuuuuuuuuuugagacagagucuuucucugucgcccaggcuggaguacaguggcacgaucuuggcucagugcaagcuccaccucccggguucacgccauucuccugccucagccuccugaguagcugggacuacaggcguccuccaccaugcccggcuaauguuuuguauuuuuaguagagacgggguuucaccguguuagccaggauggucucgaucuccugaccucaugaucuccccaccuuggucucccaaagugcugggauuacaggcgugagccaccgcgcccggccagagauagaucuuuuuucacagcuuuaccaugaguauuacucuuaaaauaaaugaccuuggguaggugcuugcauaacauaauuauguuauuuguaucguuucauagaauaaauuaaaaccuacccugugagagaacaagaagaaaaagagagucaguugaaaaugaaagugauuaaguccaucuguggggcaguuuuuggagucagauugagaaaugaaaucugauuuuuaccuguuaaugcugcugaauaauaauaauauggaauauuauuaaauugcuuuuguucucuuaacagucauuuaaauguaauugguuauggcauguagacgucuaaaaaucaucccauuccuuuaaaguuucuuuucaaaacaagucuuuuuucccuccugauugcaaaaauaaugcuuacagaacaaauugaaacacauagaaaagcccugagaagaaaguaaaaauccccuguauuuauacuacucaaagguaacaucuauaaacauuuugguauauauacuguaaguuuaaaaaauucuacaauguuucuacuguaauuuaagaauuugugcaaauaaguugaguaaagcuaaguucauccugagcgucugaaccuggaauauaaggaacuugaaauuuguagggguggggguaucugaauagaaauagaaaguucugaaaauuuggcugucuuauucuaguuaucuuuuuuuuuuuuuuuuccugaauguucuuccuuuccuucucagcuuuugccacuuuuaaguuuuuuuuuuuaaucaagauguuucacauuugauauguucuucaguaauaauagacuaaaauauaauaagauguagggaagcagaaccuaaacuguaggagguuaaaaaccagaugaaggccaggugugguggcucacgccugugaucccagcacuuugggaggcugaggcggguggaucaccugaggucaggaguuugagacuagccuagcuaacauauaguggaacccugucucuacuaaaaaaguacaaaaauuagcugggcaugguggcgggcaccuguaaucccagcuacuugggaagcugaggcaagagaaucacuugaacccgggagguggagguugcagugagccgagaucacgccacugcauugcacuccagcaacagagcaagacuccgucucagaaagaaaaaaaaaaaaaaaaaaaacacaacaccagauggaaauagaaaaucuaaaaccucuagcagaaugaagcuagaaagaauggaaucuaaacacugaaauuauacaucugcuaggcagcugugcguucuuuauuuauagguucuguuguggaaauagcaaaagaaacuuugaaagaaaaagauaucuuaaauagacuaagcauauauucuuaucacugugauaugcacauuuuuagcuguacagcauguauuucauucuuuuuuuuuuuuuuugagacagagucuuacucugucgccaggcuggagugaaguggugcgaucucggcucacugcaaccugugccuccuggguucaagcgauucuccugccucagccuccugaguagcuagaauuacaggcgucugccacuacaccuggcuaauuuuuguauuuuuaguagagacaggguuucaccauaauggccaggcuggucucaaacuccugaccucagaugaucgcccgccucggccuccgaaagugcugggauuacaagcgugagccaccgcgcccagccuuuaauucaucuuuaaaugaauuguccccauuuucuaggaguuauuaucuuuucuaaaaauaacauaacuuuuuuggauuaaauuuagauauccuauuuauaucuucagcauugaaucaauauuuuauuaaauauacauuaagggagcuucagugauacuaaaagagugugaugcuguuguaaauuugccauugcuuuccuuuuugucaauauucaaggauugucuuggaccaugggccaagccugaauuguaagaaggaaugguaaagcaugguaacccauuaaaggguaaagaaauuaaaaaaaaaaaauugucagagauauacucuuuaaagggccagauuuuuuuuauaagacuuuaaaaagaauugaugauucuuauuuuacacaaagauuuuuagaggaaagaaaaaguaugcaaaagagaagaugcucuuugaagcuggccauaacccugcugcaagcaaaaucagacaaggauggaccagaaaaagagaacaauuucuauucucacuuaucguguauuuguaaaaucccaaguaaaacacgagcaaauugaaucaaacaguauauugauacuaucggauaaagcuagcccaagauucaaggaugauuugaccuuagggauuauauuagugucauuuacacuaaauaaaucuaaggaggaaaacaauacaaccaucucaguuaaugguaaaaaauauauuaaaugaaauuaaguaacucuuugugauagacuaguuuuaagaaaagaaagaaccuuccucaaccugauaaaggguaauuuucuaccuggggcguguagcaaacccaacggguaaaauacuucccgugaaaggaagaacaauacuaaguucauuuuuaguguucuuuuuagugcuggagaccccagccaauggacuaagagaagcugaagcgaaaaaguuguaaauauuugaagggaaggucagaauguguacuguuuguuuaugcucuuugcuaagcauguaaucuaccuagaaaagccaagaaaaucgauugacaaacugagaaaacuaauaaaugaguucaguaaguuggcucuacacgugguaaacgaggaaauccauacauagguuccuguacaccagcaauagccgugugagaaguacugucacugucuguuacaucugauaaaaccugccuauuaaucuuuggccugcuugucaguuucuugucccagacaugcuuugagucaugaggagagcacuccaggagaugaggcuuucaguuuccugcuuaucucaacacgaaagucaaauguugugaaggguggacacaaggcugaugguuucaugacagccccagagagcaaaauucauucccccugaugcccaucucacccugcuauagaaaguuucauuuuuuggacagcauuuccugagagaauguaucacugaguuuucuggagaccugaggucuaauccuuaguaaucugcagaaauaccaaaggauauacuaaggaaaacagaaaaggcauuccucuaaaaauagcuaguuuuuuuuuuaauguaauagcuugcaguaaacaauggcaacaauacagaaaacugcuuuccucccuacucucuuugcucuccccucugugcuguuuccuuuuccuugguaaccaguguuguuacuguauguaucuuccuaagauuuucuuuccauuuacaaaaaugcauauccauuuuuuggugcuuuguacagauggcaucaugcauugugcauugcagcuugccuuuuucaccuaacauuuucucuaucucccuccuuuucggcugcucacccugggguucauuuccccgcagcucugucuguucccuuggcaguccucucccacugcucuccaacuccugacaccuuccauugucucucuuuuucuauuugccuucuuguucuuaaggauucuuaaauguuuuaagcagccucuguuccccuucuuagacuaauguuuuuaaauggguaaaauacguaagacuugugaaggaaaacaauuauuuugaaauauagcuauuaacauuuuuagauauaguaauacguuuguucuuuuauuaacuuauuaaauaauccaggggugaguauaacaacugcccuaauuuuuagaugcugaugagcauaaauaaugcuuugaguugccugcagcaaguaguuugaugagaauaucugauuuguuuuuauuacaaagucacagguguugcuaauacuacuguguauccugccuacucucauaaguaaagaaaaauucaaaguucgguuagugaaaauaaaaauguaaucuuuuucacaucuaagguuaugaaccucuugaauuuugugaggccaugggcuucugaauaagaacuucugcaguugaaacuugguucacacuggaggacacugauuguuuuuuguaguccacucaagcaguggaauuuucuguugcagacccccuuuccuugggccuggagggguuauccuuuacccccuuugcuacuuccagaucacucucccucccaccuuccuuaacaucaaauagaaaacaugauauucaaucucaugauacaucuuguaguuuuccauggaaccuugacugacuuccuucucauuuaaugaagauuuugucuuauauggcucauuuucucuaguacuucuuuauucuaguucuugaucucaacauccaggugggagacucuuccacuaccuuccuggccucuuaauaucuugacuuccugcaaaguuuccacccuaccucagcuaucauggucauaccccaguucuguuauacaauaauaacaaaaaauuauaaccccuuccauaauuucaguucuacccugaucaucacuucccacuuuacuggcucaugccuucuagugccaacaauucuuuuaucucacugagacuuagaacccauugacccuauuaucuuugcacuguuccucaccauacucucuccuuauguccuuacccuucucuuuauucaguuuaauuucuguuguuggucaugauuguucaguugcaaauauucucaguacacuugcccucacuugcuucauugcuuaauagagaaaccccaguuucucuauuaagaaccgcaguugguuaaauccaacugugccuacucuacacuuguacuuuuuaaaaaugugguuuagaaaaauggauaucaacugggcacgguggcucaugccuguaaucccagcacuuugggaaggcccagacaggaggauuacuugaacccaggaguuugagaucggaguggacaacauagugaaacacugugucugcaaaaaaauuaaaaaguuauuugggcaugguggcauaugcccguaguuccagcuacuugggaggcuaaagugggaggaucacuugagccugaugagguuuagguugcagugagcugucauugcaccacuguacuccagugggugacugagccugacccugucucaaaagaaaaaaaaaagaacauguauuuacccucuuaacaauuauuaaguauacaucacaguguuacaauauuguucauuauuuuauacaacagaucucuagaacuuuuuuuuuguucucugcaguuacaagcuuuuaaaaauuuuauuuuuaggccaggcgcaguggcucaugccuguaaucccagcacuuuggaaggcugaggcagguggaucaccugagguugggaguuugagaccaggcugaccaacauggagaaaccccgucucuacuaaaaauacaaaauuagccaggcaugguggugcaugcauguaaucucaucuaccggggaugcugaggcaggagaauugcuugaacccaggaggcagagguugcagugagucaagauggugccauugcacuccagccuggguaacaagagcgaaacucaaaaaaaaaaaaaaaauuaaauugacaaauguacguauuuaggggguacauaauguugacauaaauguacauauuuaugggguauguagugauguuuugauacauauaaugcaugacaggcuuguccaacucauggcucaugggcuacauguggcccaggauagcuucgaauacagaccaacacaaauuccuaaacuuucuuaaaacaugagauuuuuuuugcaauuuuuuuuuuugguagcucaucagcuaucauuaguggauuuucuuguuguuguuuuauuuaauuuuuuuauuuaaaaaauacauaauuuuuaauagaaauggggucucaccauguuguccaggccauucccaaacuccugagcucaagcagucugcuugccuuggccucccaaagugcuggauuacagaugugagccaccgugccugcccugccgcuaguguauuuuaugugugguccaagacaauuuuucuucuuccaucguggcccagggaagccaaaagauuggauaccccuacuguacagugaucagaucaggauaauuagcauauccaucaucuuaaacauuuauaauuucuuuuuguucggaacguuugauauucuccuucuagcuauuugaaacuguauauuauuguucacuauagccuuccuaccguaggauaaaggauaaaguacuagaauuuauuccuccugucuugcuguaauuuuguauccuuuaacaaauuucucccugucccucccuuuccucuacccuuccuauccucuguucuguguuuuacuuauaaguuuuuuaguuuccacaugagugagaacauguggugauuaacuuucuguuccuggcuuauuucauuuaauauaaugucuuccaguuccauccauauugcugugaaugaguggauuuuauuuauguauuuucuuuuuuuuuuuuuuuuuuuaaguagagaugggguuucaccauguuggccagucugaucuugaacuccugacuucaagugauccauuccucucagccugccaaagggcugggauuacaggcaucagucaccauacucagcccagauuuuauuuuuuaugacugaggaguauuccacuguguauguauaccauauuuucuuuauccauuccucuguuauuagaugucccguuugucuaacccauaucuaggcuguuugaauagcaguaaacauggggaugcagaugugccuucaacagaaugauuuccuuuccucuggauaaauuccuaguaguggaaugcuggaucauaugguaauucuguuuguaguuauuugaggaaacucuguacuguucugucuuguggcuguacuaguuuguauucccaccaauaaaguguaaguguucccuuuucuccuguccuugucagcacuuguuacuuuuuaaauugaauuguuuaucuuuuuccccguuugcccauuugcccauuuuuaauuggauuguuuaucuuuuuccuguugagauguuugaguuacuuguauauucuggauauuggccauucuuuuugauaauagccguuuuaacugggguuagaguugugguuuugauuugcauuucccugaugauuagugcuguugagcuuuauuuauuuauuuagacagaaucuugcucuguugcccaggcuggaaugcuguggccugaucacuguccacucuaagcucaaccuccugggcuuaggcaauccuccuaccucaacuuccugaguagcugggacuacagaugugugccaaugggcccagcuaauuuuuaagaguuuuuuggagagauugggucucgcuauguugcccaggcuugucucaaauuccuggccuucagcgaucuuucagcaucagccucccaaagugcugggacuacaggugugagccaccaugcucugcccuucuuuguuuuuguuuugugaaagagacaggaucuccuugucacccaggccagaaugcaguagugcgauccuaacucauuauaaccuugaacuccuggccucaagguauccucccaccuuggccucccgaacgcugggauuacaggcaugagccccugguaauagcaccuggccuauuucauuuguuuuuuggccauuuuucuucuuuugagaaaugugucuguucagaucauuugcccauuuuuuaauuggauuuguuuugcuguugagauguuugaguuacuuguauauucuguauauuaauccccuguuggaugaguaguuugcaaauauuuucucacuuucuguagcucgucucuucaugauguuaauggguucuuuugcugugcaguagcuuuuuaguuuaauauaaucccauuuguuuauuuuugcuuuugaugccuguguuuuugagguuuuacccauaaaauauuuucccagaccaguguccuaaaauguuuccccuauguuuucuuacagugguuuuuaucauuucaaaucuuuuuuuuuugagacggagucuugcucugucgcucaggcuggagugcaguggcacgaucucggcucacugcaaccuccgccucccagguucaagcaauucuccugccucagccucccgaguagcugggauuacaggcgugcaccaccacgcccggcuaauuuuuguauuuuuaguggagacgggguuucaccauguuggucaggcuggucucgaguuccugaccucaugauccuccugccuccgccucccaaagugcugggauuacaggcgugagcgugagccaccacgccuggcuaaggauuuauaauagauuuaaagcauucugaugggcaaagaaccagggaaaggaaagucaaaggcaguacuguccaauaugacauguaauuuuaaacuuucuaguugccacauuaaaaaaguaaaaauaaucgugugaaaucaguuuuguuuuuucaauugagacaaggucucaccacguugcccaggcuggucucaagcuacuugggcucaagcaauccucccacagugcugggauuacaggugugagccaccgugccuggccaaaaucaguuuuaauauauuucuuuaaucuaauauaucccuaacaguaucaccauguuggucaagcuggucucgaacucuugaccuggugauccgcccgccuuggccucgcaaaguacugggauuacaggcgugagacaccaugcccggcucucauuucgaaucuuacacuuaggucuuugauuucuuuugaguugauuuuuguauagggugaguguugggcgucugcuuuuauucuucugcauauggauauccauuuuucccagcaccauuuauugaagagacugucuuuuucccaaugaguguuuuuggcacuuuugugagaaauccgcuggcuguagauagguagauuaauuucuggguucucuguuuuguuccauuaguguauguaucuguuuuuaaugcugcaccaugcuguuuugguuacuacagccuuguaguauauuuucagguguuguauugugauaccuccaacuuuuugcucaggguugcuuugguuauucgggggcuuuugugguucuguacaaauuuuaggauuuguuuuuccgugaagaaugucauugguauuuugauagggauugcauuggaucuguagauugcuuuguguaguauuucuggcacuuucucaucuugccugacugaaacucuguacuuuagagcaacucccuauuucccucucccuucagcuccuggcaaccaccagucuaccauuuuacuuucugucucuaugaguuugauuauuuaagauaccucauguaaguggaauuaugcaguacuuguuguuuuaugauuggcguauuucacuuagcauaaaguccccaugguucauccauuuuguagcauaugacaggauuucuuuuuuuuuuuuuuuuuuuuuuugagauggagucucacucugucacccaggcaggcuggagugcaguggcgcgaucugggcucacugcaacccccgccucccagguucaagugauucuucugccucagccuccuaaguagcugggauuacaggcaugagccaccacgccuaauuuuuguauuuuugguagagacgggguuucacuacguuggucagccuggucuugaacuccugaccucaggugauccucccgccucggccucccaaagugcugggauuacaggugugagccaucaugccagguccaggauuucuuuagggcugaauaauauccaguuguguauauguaccacauuuguugauccauuuaucuguugagagacacaaguuaauuacacguuuuggcuauuguagugaauagugcugcaguggacaagaguauguaaauaucucuucgagauccuguuuucaauuuuuuuagauauauacugagaagugggauuucuggaucaucugguauuccauuuuaaauuuuuugaggaacguccauacuguuuuucauagugauuguacuguuuuauagucccaccaacaaugcacaggaguucuaauuccuccacauccuugccaacacuugguuuucuguuuuuuuguuuuuuguuuuuuuuugauagagguaauuuuaacuggugugaggugauaccucagugugauuugaugugaguuuugccgaugauuagugauguugaguagcuuuucauauuuuuuuuggccauuuauguaucuucuuuguaaaaaugucuauucaaguccuuagcucauuuuaaaguuguguuauuugugguuuuuguuuuguuacugaguuguaggaguuuuuuuuuuauucuggauauuaaaccccuauccaauacaugauuugcaaauauuuucucucauucuguagguugccuuuucacucuuccuugguuucauucugguuuugguugauugcuugccuugcugcacagaaguuuguaaguuugauguaauucugugucuauuuuugccuuuguugccugugcuuuuuguuuugcagccaagaaaucauugccaaauucaguaucaugaagcuucucuauguuuccuucuaguuuuaugguuucaggucuuauguuuaggucuuuaaucaauuuuuaguuauuuuuuauuuaugguuuaagauaaggauccaucuucauucuguugcauguggacauccaguuuuuccagcacuauuuguugaagagauuauucuuuccccauugcguagucuuggcucaucauuugaccacauacacagggguuuauaucugggcugucuguucuguuccauugguuuacaugucuguaugcuaguacuauuuugaucacuguagcuuuguaacaaguuuugaaaucagaaagugugaagccuacaguuuuguucuuaaucaagguuguuuuggcuauuugggguccuuugagauuacuuacugauuucaggauggcuuuuucucauuuugcaaaaaaugacacugaaauuugauagagauugcauugaaucaguagauuacuuuggauaguauguacauuuuaacaauauaaggucuuccaguccuugaacaugagaugucuuucccauuuguguguuuaauuuuuuccucaguuuuuugucauuuuuaguguacaagucuuuugccuccuugacguuuauuuuuaaguauuuuauuuuaguuuuacuuuauuuuuuuagaaacgggaucucguucugucacccagguuggagugcaguggcgugaucauggcucacugccaccucccacugcugggcucaagagauccuccugccucagccuuccgcguagcugggacuacaggccugcaucaccaugaccagcuaacuuuuaaauuuuuuguacagauggggucuugccaucuugcccaagcuggucucgaagugcuggaauuacaggugugagccacugugcuggccuuauucuuaaguauuauucauuuugauguuauuauaaauggaguuauuuucuuaauuuccuuuuuguguuguuuauuguuaauguauagaaaugcaacuuauuuuuguguguugacuuuguauccuccugcuuugcuuaguuuauuauaauaguucuaacaguuuuuuugugaaacccuuaggguuuuucauguauaaaaucaugucuucugugaauggagauaauuuuacuucuuccuuuccaauuuggaugccuuuuuuucuugccuccuuuuucugauuguacuguguugaguagaaguggugagaguggacuuccuagucuuguuccugaucuuagagggaaagcuuucaguuuuucaccauuguaauguuugcuguggacuuuuuauguauggucuuuauuauguucagguaauuuccuucuauuccuuccuaguuuguugaguguuuuuaucaugaaagguguugaauuuugucagaugcuuuuucugcaccaguucagauuguuacaugauuuuuguccuucauucgguuaaugugguguauuacauuuacugauuuuuguguguugagccauccuugcauccuaggaauaaggcucccucagucaucguguaugauuuuaauaugccuuugaauuugguuugguaacauuuuuugagaauaugugcaucaaaguuuagaaguguuucuucaguuuuuuuggugagacuuugaggagguuugguauuaauuuuucucuaaacguuugguagaauuccccagugaagcuaucugguccugggcuuuuuuuguuguugggaaguuuuuaaaauuacugagucaguuuccuuacuaguuauagguuuguuaagauuuucuguuucuucgugauucaguccuggcagguuguguguuucuaauaauucauccauuucuucuagguugucuaaauuguuggcaugugaucguucauaguagucucuuauccuuuucauuucuguggcauuuguuguaauguccccucuuucauuucugauuuuaauuauuugagucuuguuuuuuuuucuuaaaucuggcuaaggauuugucaauuuuauugaucuuauuuaagaucuuuuuaaauguaggcauuuacugcuauaaacuucccucuuagcacggcuuuucuguaucccuuaaguuuuggaauguucuguuuucuucuucauuugucucaagauguuuucuaaacugccuugugauuucuucuuugagucauuaguuuuucaaaaguguguuaaauauuugugaauuuuuuaguuuuccuacugcuuuugauuucccauuguggucagaaaagauacuugcuaugauuucagucuucuuaaauuugcuaagacuuguucuguggccuaacaugugaucugucuuggagaauguugcauguguacuugagaaaauguguauucagcuaguguuggguguaguguuuuuuuguuuguuuguuuuugagauggaguuuccgcucuuguugcccaggcugcagugcaguggugggaacucagcccaccgcaaucugcgccuccuggguucaagugauucuccugccucaccuucccgaguagcugggauuauaggcaugugccaccacaucuagcuaauuuuguauuuuuaguagagacaggguuucuccaauuuggucaggcuggucccgaacuccugaccucaggugaucugcccacuuggccucccaaagcugggauuauaggcgugagccacugcgcccggccggguauaguguucuuuauguguccguuaguuccaguuacucuccaguguucaaauucugugucuccucauugauccgcucuccggugguucuguccauuauugaaaguggggauacugaaaucuccugcuguuacuggguuacugucuguuuuuucuuucaauucugucaguguuugccuuguuauauuugggugcucugguucugcacuugcaccuuuacagcugcgcuuggcuggagaauuaacuuggcugauuggccuuaccacuaauuaccacuaaguucaggagaguccuuaaaacugcacagcaguaguuccuaguucauuuauucucccagugugaccuaaaugaucauuuagaccugcuccuucucaauccuucaacgucacuuucaccgucuuuagcacacaacuuugcuuuucauuuuguugagaaaacagauaccacaagaaaaauaucugcaaagcuccugccacuacugccugugucugugcuucauguauucucacaucccucaauuauuacggaaugaacugaccaugcuucuagccagggccaaaaccugcacugugcucacucagcccuugccucuacacucugcagggucauucuccuccacaacaacauacuguuguuucucucaucuuaaaacacaacaaaacuucucugaacuccauuuuuccuucuaaccguuguucauuucccaccccgaccccuuuuuucccuaaaagaaguaucugcacuuuguuuccaauuuuucuccuccugauauuucaggaggcuuucccucccagcacccuguuucuugcacugcucuugcgaggucagcucugacccuaccuuucucauccuugaauuauuugaccuaguaacaguauuugacacuggugauuacuuauuuccugcucguugaaacacuuuguucacuuggcuuccaggauagcauacaaagaaauuccccaucucagucuuuugucacagagucccuccagggcucaguccuuagaccucuguuuuaacuaugcucauuuccuuguugaucuuauuugacccacuggcuuugaaacccucuuuguuuuaaaguuugacggaaguccaaauuuuaaaucuccagccugagccgcuucuuugaaaugcagacuuauguuccaccuggaugucuaauaggcaaaugaaaugcagcuuucucuaaagggaacuuauucuuccuccaguaacuuaaugggccaugcuuagaauggcucuuuuuguccaagaaaauucaaaaccaaaaccaaaucuauuuucuucugcuuuaacaucagucuacagauuauuuuuggucuaaagcaugagauagggcuuuuuauuuauuuuuaaucaggcggcuagcuaguuucuuaacaguauugaauaauauauuuuuaauuguuugaauugucaucuuuauuguucugagaauaauaucaaggauuuaagugaaauugccaucuaauguuugcauuauagauuucaugccccuuuaaaacauguguuauaucaauugagagcacacucuuauaaaguacaaucaaugauaaucaauggauuuuuuaaaaaagaacuaaauaaguugcauaagagcacagaaacaaacuuuaaauuuagcauuuaauagaccaggaacaacacaccaguaaagaaaggggucacuaauuacuguuuggauacuuggauuuuaguuugaaaaauaaguaaaauuuacauaguaaaaagcaauaaaguaaauuuaacacggaaaguaacaauggaguaugaaauauaugaccaaacuaauggaaguuucugucuaaaauaaaagaucuauuuguaggguaaguaauuagauugggaguaaaaggcagaaauaguaaaaucaucacaugcacaaaugcugucuguauuuaaucccaguuaaagacaugggaaauaagauaacccuaaggcuauaaugcucaccuauuaaacugacagaaguauguaauaugaggaaauagcaugucuuguuuggucaguguauuagucgauucucacauugauacaaagaaauaccaaagacuggguaguuuauaaagaaaagagaauuaauggacucacaguaaugcaggcuauacaggaggcauggcuggagaggccucaggaaacuuacaaucauggcagaaggggaagaggaagcaggccuaucuucacaugacagcaggagagacagcaaagaggggaaugccacaugcuuccagaucucuugagaacucacuaucaugaguacagcaagggggaaaucugcccccccccauaauccaaucaucucccagcaggccccaccucuaacacucaggaucacaguucaacaugagauuugggugggaacacagagccaagccaugucagucaguaucauaaauugguucaaccauagaggaagagaauuugacuaaauacauauuuuagggaaaagggaaguacugugggcucagcgguuugaucuuaaaauuucuaugcagugauggcauacuauauuccuaaucuaacuaggguuuguuucaagggaauuagggauaaggugaguaagcuaguaaacccaaggcaaaauuucuuaaugcuuuuuaaaauuuaaaaaagaggcccauuccguuagagcauacauugaaucaaauguuucauguaaaacaggauggaaaugaacuuuucuauuuggcuaagugguguaggcagaaaaaccuauaggcuuucucuuuucaucaacuucaugcugaguccugucucauuuuauuauuuacacaauugaaauauaaaaaauuguucccaaaugaugccccccauacccuaaguuuagggggcaguaguguaaagcaguguccagacauuggucuuagggcuggaguggaaacagacuccuagaggugcacaagcacauggauaauuuuaccugaaucaauuuccaaauccuaaacuuuaaaugucucuuuuuugaagcauuucuuccuuugaaccaguguucaagcgguucuucccuuuuuauuuuuugauguggaguuuggcucuugucacccagguuggaguugcaauagugugaucucggcucacuguaaccuccgccuccuggguucacgcgacucuccugcuucagccuccugaguagcugggauuacaggugccugcaccaugcccggcuuauuuuuguauuuuuaguagagauaggguuucaucauauuggccaggcuggucucgaacuccugaccuuaggcgauucacccaccucagucucccaaagugcugggauuacaguugugagccacugcgcccaguucuguuuucaaauuccuuuccaccauggcuuuuuccauuauuaaaaaaaauggcauaacucuuccucugacccuucucuuaccaugaugcacuugccuuguagugggaaaaccucagggaugaaaagggugucaggacaauucuaagacaccaauggaauagugcuggaagaauuagauauucaguugcaaaagaaugcaauuagaccuuuaccucauaccauaaacaaaaaucaacucaaaaugaaucaaaaaccuaaauguaagagcuaaaaccauaaaaaucuuagaagaaaacauagguauaaaucuuggugaccuuggauuaggcagugauuucuucaauaugacaacaaagcacaagcaaucagaaaaaaguagauaaauuaaacuuuaucaaaauuaaaaaccugugugcauaaaaggacgcugucgagugagaaaacaagccauagaaugggagaaaauacuguaaaauauauuugauaagcagcuugugucuagaauacauaaagaacacauaacuggcugggcgccguggcucacaccuguaauuccagcacuuugggagacugaggugggcggaucacuugaggucaggaguucgagaccagccuggccaacauggugaaacgccaucucugcuagaaauacaaaaauuagcugggugugauggugggcaccuauaaucccagcugcuugggaggcugagguaggagaauugcuugaaccuggaaggcagagguugcagugagccaaaaucaugccacugcacuccauccugggugacagagugaaaacucugucuuagaaaaaaaaaacaaacaaacacguaacuaacuuagaaaaccaaaaaucuaauuuaaaaacaggcaaaggauucagauagacauuacuccaaagaagauguacaaauggcuacauaagcucaugaaaauaaugucguuagucauuagaaauauaaaucaaaggcugggcacgguggcucacgccuguaauccuagcacuuugggaggccgaggagggcagaucaugaggucaggagaucgagaccauccuggcuaacacagcgaaaccccgucuccacuaaaaauacaaaaaauuagccgggcgugguggcagguuccuguagucccagcuacucaagaggcugaagcaggagaauggcgugaacccaggaggcagagcuugcagugagccgagaucuugccacugccacugcacuccagccuggacgacagagcgagacucugucuccaaaaaaaaaaaaaaaaaaaaaaaaaaauauauauauauauauauauauauauauauauauauauauauauauaucaaaaccacaaugagauucugcuucuuacccacuaggaugucuauaaucaaaaagauagauaauaacaaaugcugguaaggauauggagaaaugggaaccuccagacacuauuugugggaauauaaaaucgugcagcuggucuggaaacagauuagcaguuccucaaaaagcuaaauguugaguuuccauaugauccagcaguuccacuccuagauauauauccaaaagcauuaaaaacauguucacacaaaaauuugugcaugaaaguuuacagcagcauuauucauaauaggaggaaacaacccaaauguccaaccgauaaauagauaaacaaaauguggucugucuaggcaauggaauauuacucacccaugaaaagaaaugaaguacucacucauuuuacaacauagaugaauuuugaaaacauuaaugcagguugaaagaagucagucacaaaauaucguauguuguauuauucuuauuuuuaugaaagguccggaaaagguaaguccacagagaaaguagauuagugauaaaaauguacuggaauuaguguugaugguugcacaacuuugugaauaugccgauagcuacugaacugcacacuuuaaaagagugaauuuuauuauacgucaauuauaucuccaaagaauggaauaaagccucaggggcccccaaaguggugauuccaaauauugguuuuaguguuaagaaaaugaauggccauagccuuuggagaacaaauccuuucaugguuuuucaguuuuccacuucuaacaaaauugaaggaucaauuccaauauuuacaaauaauaaauguguuagcuacuaaaucauuuaaaauauuucugguggaaaacaacuauguaauuuucaacagauaacucagaagaaauuuuaaaagucaugugacccaacugacagaauuccuuuuauuuccaucaccuguuuauaugagcaagccuucucagugcuugcuuuuuuuuuuuuuuugagacaaagucucgcucuguuucccaggcuggagugcaguggugcgaucucggcucacugcaagcuccgccuccuggguucaagcaauucuucugccucagccucuugaguagcugggacuacaggcacgugccaccaugccuggcuaauuuuuuguauuuuuaguagagacgggguuucaccauguuggccaggcuggucucaaucuccucaccucgugauguccccgccucggccucccaaagugcugggauuacaggcgugagccaccgcacccagcccucagugcuuucuugaaacacacgcacagaaaaguagaaauucacuaagugaugucugauuuuagcaauaauuauucaaagagauacaugaacuaaugaagaaaaaaaaaaagcccuguccaucucauuaagagacguacauuuccaguaauuuuucuuuccuucuuuacuuccuuccucccucccucccucccucccucccuuccuuccuuccuuccuucccucccucccucccucuugcucuguugcccaggcuggagugcaguggugcacuauuuuggcucacugcaaccucugccccuggguucaagcauuucucccaugucagccuucccgaguagcugggacuacagaugugugccaccaugccuggcuuuuuuuuuuuugcuagagauggggguuucaccacguuggccaggcuggucucaaacuccugaccucaagugaucgccugcuuuggccucccggaagugcugggauuauaggcgugagccacuguucccagccuccaguagaauuuuuaccuuuaauguuguuaauuacugucagaucuuuuuuuuuuuuuuuuuuuuuuuuagauggacucuuacucuguugcuaggcuggagugcuguggcaugaucucugcucacugcaaccuccaacucccugguucaagcaauucuccuaccucagccucccgaguagcugggauuacgggcacacgccaccaugccuagcuaauuuuuguauuuuuaguagagauggguuucaccauguuagccaggauggucuugaucuccugacauugugguccgcuugccucagcuucccagagugcugggauuacaggcaugagccagcaugccuggccuacugucagaucuuuaauguuugccauuuaaaugaauugcauacugcuaaaaauuauaaugguaauugaauucaaaauaauuuuuuaaacacuuagaagcuucuuuauggucaggaaauuuaaaauguuuuucauuuaaacaucagacaggcugggugcaguggcucaaaccuguaaucccaucacuuugggaggccaaggcaggaggauugcuugaguccaggaguuugaaaccaaccagggcaacauagggagaaucugucucuauaaaacaaacaaacaaacagaacuucagacauguaugacugagugacuaauaagacuuccaagcauuagcaauuacuauaugcagggcaaauguacuggaaauaugaauucaaggaggaaaauaugcugugaaaauuucacuuuaaaauggaucaugauggguaucagaucacaauuguauuuggauucuguugaagagauuuaagguugauauuacagugaccuugcuaaauuauauugcuguucugugcucuguuucccuauauauaaaugggauaauaauagcaccuauaucaaggaguaauuuauuauuaugucuagugcagcuucuuggcaaauacucuguucagugauucacauucuguuuaauagcccacugcuuuguuucuuucugguaagucuucugccuuaaugcagucuucucuagcuacuauguguccuuuuuucauccuccugaucuauacccccccccaccccccgccaccccacacacacauggugguguggacaaggcaaaaaagaaaguuagcuggauuuauguuucggaauuucagggcuuuguauuuacaguugacuuguuaggagaagaggaagaagaauuaaaaaguauagcauugggccagaauaucauuaagcaguaagaucacauugaguuguauagggaaggguaccuguauuuuuauuucaucuguacuggagacaggauuucugaugacacgcuugcucacugacaguuuuuuuuuuuuuuugagauggaguuucgcuguuguugcccaggcuggagugcaauggcgugaucucggcucucugcaaccucugccucccggauucaagcgauucuccugucucagccucccgaguagcugggauuacaggugcaugccaccacgccuagcuaauuuuuguauuuuuaguagagacaggguuucaucauauugaucaggcuggucucaggugaucugccugccucggccucccaaagugcugggauuacaggugagccacugcgccaggccugacagauaguuuuuuuagaugguguaagacagugucaauuauguaguguaguugguauauuuucuguuguuacuguaacaaauuaccauacuuuuagugguuuauagagcacaaauuuauuaucuuaugguucugcaggucagaaguccaacacaggucucacuaggcuaagaugcaggugucuacagggccguguuccuuucgggaaguucuaaggaaguauggauucugugccucuuacagccucuagaggcuggcugcauuccuggaucaggcuccccuuccuguucaccuucacagucagcaaggugacauggcucugaccuccugucaucucuuucccaccguacuugggagaaguucucugcuuuuaaggaccaugugaguagauuggucccaacaagcucauccaggauaaucgccccaucucagguuuuggacccuuagucacacaucugcaaagucccuuuugccauuuaaauaacauauucauagguuacagggauuaggaugugaaugucugcaggggccauuauccugcuaccacaguugguuuuuagucagcuacauaauuuugaacuguuaauuuuaucuauuuuuuuuuuaugacaguugugguuagaggugaggcuuggauugguccuggccugaaucuuguucugcuguguagcagcacugugacguuaggcaaguuucuucucuguacuuguuucuucuuuggugaaaucaagauaguaaugcuugucuguauguacugaaauaaaguaauaguuuaggguucuagaugggaggcaagagauuucuaccaaucuuuuugugucugucucaaauaagcaaauaugugaucaccuaacucacaagguuguugugaagaucaaauuaagucaucaaguuagagugccuuuugaaauguauaaaaaguauauaacauuuuguugguauuaauuuuagaauggcuuuuaagauuuuugucaaaggugagaacguucaguacauucuuugauaccugccuagcaacuauuuuuagguuucuauuccuuuccagauuuucagauucacauauuuccuuuauuaaauuaugguaaaugaaaagauaauaugagaauuaaaaguaaugacuucugugauucguauagucacuaggauuuaaaauucaaauuuaucuauaucuauaucuauagauauagauauauagauauagauauaguuuuuuuuuuuuagauagagaguuucgcucuuguuucccaggauggagugcaauggugccaucuugacucaccgcacacuccaccuccuugguucaagcaguucuccugccucagccucccgaguagcugggauuacaggcaugcaccaccacaacuagcuaauuuuguauuuuuaguagagaugggguuucuccauguuggucaggcuggucuugaacucccgaccucaggugaucugccugcuucugccucccaaagugcugggauuauaggggugagccaccacuccuggccuaucuagauaauuuuuaaucuuuauuuuuuuuuuucuguagacuuauuuggagcuauacuauauguguuguagaagcaaaauaaauacuaagucuaccuugcauuaguaagacugauuuuucuuaaauccugagcuacauuuaaaaucuugguuaguagacauuuuacucagauagugauucauuuauaauuggcuugucuaaguacucaguguuugacaaaaauaucacuauguuaagcaaaaaccauauuuaaaaagugauuuguuuuuuuuuuuuccuaacgcuguaacagugaauagaucuuuuuccccuaagcagcacaaagaugccauuuugggagguuaaauuacuuucuaaaaguugcugugaaggagagaaggaaaagagaucagguuacacauucuuuguuccugagccuaccacugcacacguucagagaagcaauagugaggcuagaguaugcauuugccacuaugucuucaacccuuccccauaguagggagggagggaauuaggcaguuuuccuaacagggccccgaagaguaccauuuuaacuuaaauacucuuaaaaguugcuacuuauuuuuuuuaaggcuuucuuuacuuuuuuauaauuuagcauuucaaguaauccaaauaguuauuucuuuguauauucagagguauuuaaaaauauuuucuuugagagcuuaaagguuauaguuuaauaaugcaguuaaacaucaauuuaucucaaauugauauugaguuaaauuuaaagaguauuuuaaauuauauuuugaggggaaaaaaauaacuuucuuggcacaaaauggccaugaauuagauuguguguuucagaaagguagugguaaaaaguccccaaagcaguuacaauauuucuuuuguucuguuuccuugcuacucuuagauaaaugaagaguuugaaaagaauuuucacauaaaaacgucauaaaaucccagugccauauucugaauauuaauuugacuguuuuaugucguauuuuuuucccaguugguuuuaguuagaauauaugcuuuuuuuuaagccuuuaaggaauuaaacaauuuugguuauuaaaguuuaaauguauuucauaaauauguauuuauaaauaugugacuggucccuuuucugagggguuaggaaguuuaagcauuauuuguaagcuauuuguaaaucccugucaaacauuauuuguccauuaagaaauacuauuuuuuucuucacuuuuaggucauuuuaaguauuaauaauguucaucaauuuacuuacuacccuucugaagaaagucacuauaauuaguaaucagaauuauaucacauaaauuuaggcacauuuauuuauuuauuuauuuauuuauuuauuuauuuauuuuuaguauuuugagaguaggugcuguauuuucuuuucuuuccuuguuucuucuuuuuuguuuuuugagacagaaucucucucuguugcccaggcuggaguacaguggcaugaucucaguucacugcaacuucccccuccuaggcucuagcagugcuuccaccucagccucccaaguagcugggaccagcucacgcuaccacuccagcuaauuuuuguauuuuuuguagagacaggguuuugccaugucaccgagacugaguuacuguauuuucuuagcagaauauugucccagugagcuuuuuccaaaagagaaaagguacagccaauaaaaguuugugguuggguauugggaguugguguuguucuguuuuguccuguucauaaaaguuuuauucucuuuagcucucaugcuuuaguucuaauuuauucacagauuuuugcccaguaacuugauuuuauacuuggcuuucuauauuguggcuccaauuuuucuucccaguuuauacucuuauuuuuccuuucuuuuucuuuucuuuucuuuuuuuuuuuuuuuugagacagucuugcucugucgcccaggcuggagugcaguggcgcgaucucugcucacugcagccuccgccucccaaguucaagcaauucuccugccucagccuccagagcagcugggauuacaggcgccugccaccaagcccggcuaauuuuuuuuuuuuuuuuugagacggagucuugcucuguugucugggcuggaguguaguggcccaaucucgguucacugcaaccuccaccuccuggguucaagugauucuccugccucagccuccugaguagcugggauuacaggcgcccaccacuauguccagcuaauuuuuuguauuuuuaguagagaugggguuucgcaguguugguugggcuggucuuggaacuccuggccucgugauucgcccacuucggccucccugaguguugggauuacaggcaugaacuacugcgcccagccaauuuuuguauuuuuaguagagacgagguuucaccacguuggccagccuggucuugaacuccugaccucaagugauccgcccaccucagccucccaaagugcuggggauuacaggcgugagccaccgugcccggccagaauuugaacuuuaauucuucaaauuguauagcauuuucagguaccaucgagggcuuuucuucuguacuucuguguguucaaauauggaccuuguuccaaaaagguccaaaaagguugaguugugguucccuguaaugucaagaaaucuguuaaugcaugagacccggaagauguuugaaagugacuagugagaauuggguugguugcuguaggauauugucauuuaaauuauuaagugaauauauuuauauauuuaaaaauuagauguagguaagccucagaaaugggaaaauggagauaaaucuuaggagagauuuuugaaucuuuuacuuaagacuguguucaaaacuuugucuauuugcuauuuauuauuuugauauauuaauugcuagugagauuaagacauuuuugacacauccucuucauuuaaggucauggauguuuuguaucauucuuauauaagcauauuuguaagacuuuuagagguauuccuuuuuuaguccuauuuuuuuuuacuagggaauuaugacucauuuuggcacuuagcuuuuguagcuuacuaccguaugacauuuuauaucuuugcaaaaaccaaguaauuagaccauucaucacaauuuccauacuuaaaaaacuaauacuaaguuuuuacauguuaucaauaaaaguagcauuuuaacaauuauccuuuccacauuauuugauaaaugcuauugguuuugucuguuauuuuuauaaauauauaauuugcuuuaauuacuuaaauguuccuugagccuuagaacuuaaauccugaugaggguuuuacuuuuuaaaauacugaaguuuauuauuuaugcauguuuuacagaaaaaugaguggcuuuuaaaagaucaaaauuaaaggcuuaaacauggaaucucuaggacauauaaaauaugaguagaacuguguauuuauaagauguuaauguaagacuucaggccuuguaauaucuuaaaggaaccacuucacuguaagggagcaguuugucuuucuaccuuuccaauuguauugagauuuugcccaguaugucuuuuuacuuaaacaccuuggugaaagcuauccagcauccuguuuuaaaucuccuuuguugcacuuaccauaauuacuuucagaucuguuuccauucucagaaacugaaacuguaagcucaugugaguggggaauccgacuuguuuuauugcaugugagcugagcacugugccuugugucaguagucagugguguuccuuuaguccuuguuauguuaauaaaaaagcuuugguuuuugcaagacuuuguuuuuagagauucuggaaaggaacauauuaaccaaaaagaagagcugacuucaauuuuacuugucuugaaaauaacugacuacuaaagggaugucagggaacauuagugaaaauggagaacuuaaggaguuaaaguuuuagcuguuuuuuucaaaggauauuguccuucaaaaucuuuaccuugcauuuuuguuacugugauuuaagaugguuguaauuaucauugauugaugauaccuaucaaaaggcaacccuaaccaaccauuucugcuggauucugaaugccgagaaagaaaaacugagaaauuugugaacuauuacaagucgucuguaaaaugagauaauaauaucaacuucacaagguaauuuaggcuuucgugaaaacuagagugugaaaaugcuuaguaaugugcugggcacacugcaggugcucuacaaauaacuacugauaacuacuuuuuuucaugaguaauuguacauuuucuuucuuccuuccuuucuuccuuccuuccuuccuuccuuccuuccuuccuuccuuucuuuucuuuucuuuucuuuucuuucuuuucuuucuuucuuuuuuuguuuucuuuuguuuugagacaagaucuugcucuguugcccaagcuggagugaaguggugugaucuuggaucacugcaaccucugccucuugggcucaagugauccucccuccuuauccuccugaguagcugggacaacaggcgcacaucgucacacccagcuaauuuuuguauuuuuguagagauggggcuucacuugguguugaauuccugggcucaagcgauccacccacuucgaccucccagcgugcugugauuacaagaguaauuguaaauuuaaaaugaauuucuuucccaucccaaaccaguaucaaaaugcaaauauaguaaauuacuuuuuaaaagagagauguuuaauggcaguuguugguagucuuuugagucuuuaaguggguauauuauagaaaaacaacauaucucugcuuggagggaagauuuaacuaaaaacaagaaaaagaauaguagaugaaccaugauucuuuaacauacagguugcaaacuagugaccugucaguuggauuuggccuguaggcauguuuuuggcuuauaauguaauuuuuuaaaaauuaguggccaacaauuaaaaauugggagaguuuucaaaagaaaaugcagauuucugacucaucuugaaaaaugguaagaugggcagcacagggccuguauucccaauugcagcccucaguggagcuaaguaggcuguucucccugccaucugcccggcucucaguugccaucacucacugcauuuggacucuuucuucauauagugagccgaggggggagugauagucucauguuccuaucaaaagagggaaaccuaaaauaaggccauuuuuguuuuuguuuuuguuuugugagacggaguuucgcucuuguugcccaggcuggagugcaaugugaaaucggcucaccgcaaccuccgccucccagguucaagcgauucuucugccucagucucccaaguagcugggauuacaggcuuccgccaccaugcccagcuaauuuuuguauuuuuuaguagagacgggauuucaccauguuggccagguuggucuugaacuccugagcucaagugauccacccgccucggccucccaaagugcugggauuacaggcaugagccaccacaccuggccaggcgauuuguguuuuaagaaaaacaagaaagcauguaauucuuugcgaaaauaaugaacauuucuauuuauaucugucaaaaguccuguuucuuaggaguuaagacauaauucauagcaauuaauauauguggagaagauacguaaugaaaaacuaacuagaagaggaauucagacauugaaagggauuauuuuaaagugagaauaaaauuaguagugccgcugugaggaaaauaaucuucacguacuuacguaugaugagaaacuuccuaagugucuagagauggcaagaaacuuuguauguuuugcaugacaguaauuguaaauaugagcuuaucuggaaauauuguuugcauagauguuaaaaauaugggcaggacaauguguacuaaaaugcugaauucuagugaggcugacauaagcuuauuuuuuaaauucuuuaauuuuuguuuuuauauauuuuuugagacagggucucauucugucacccaggcuggagugcaguggugcuaucacgggcucacuggagccuugaccuccccacgcucaggugauccucccaccucagccuccugaguaguugguggcgugcgccaccaugcccaacugauaguuuguauuuuuuguaaagaugagguuucacuguguugcucaggcuggucuugaacuccugggcccacucaagccauccacccaccuuggucucugaaaguucugggauuacgggugugagccacugugcccagccugauagaagcuuagagauuaauaucaccuaguuagcucuguuuguguaugguaucugugugaauuuugacuguuucuccccucucuucuuuagucauuaccccuguuuuugguucauuccuaucaguaaacaaucucugguagagacuugguaagaaaacucaaccauucccuuaaaaaaagucagccucuaccccuuccuuagccagaugcuucagggauggucugcuugcaacacuuccuguccuucaccuucuuucaacuguuuaaccugccuuauucuuuuuuuugugagacggagucuugcucugucucccaggcuggagugcaguggcgcauguuggcucacugcaagcucugccucccggguucacgccauucuccugccucagacucccgaguagcuuggacuacaggcacccgccaccaugcccggcuaauuuuuuguacuuuuuuaguagagacggaguuucaucauguuagccaggauggucucgaucuccugaccuugugaucugccccccuccgccuuccaaagugcugggauuacaggugugagccaccgccccccacccuugccugauucuuauucucuuguccaccacaguuugcauuccucaggccauuuuugucugcgucguugagggccuccauuguccagccccaucuccuuuacucucucaguagcauuuggcacagcuggcucuccugugccaaacucuuagccgcugugacacaacucugcauauagccuuccaccucuuucagcacaguccagaugguggugagggacgcuccagaucagggcugaggauggugucuuguuggcuucugcccuuacccugaaucccuuaagcccuguguacagugaguaucauaauucuggccuuauauacuguacccuacauuuugggcuaauuuaugaaaggauaaaaaauaggacuuggaaaguaaaaauaacccauguuaaagaaucugaacuacauuaguacuuuuugccucuauacugcacauacaaaugcuugaaugacuaugauguaaaggaaagggagaagaaacuaaaaauuugacgugggaugucacauucaaauaagcaguuuuuuccccuuuagaacauuugcuuauaaccuaggucauuuaaccaguugagguucaaguagcucucagaucagcuggugcaagcuugagggagaaaaaaaaaaaaccauccuuacagauacuucucauucauuaaccucgaauguuagcuuuaaucaguuuaggaauuuguaugcauuuuaguaacucaacaccaacuugucagaaguuagcugaauuuuagauaauuucuuucauuccagccaaaaauaauaaucacagacauguuuaaaaaaaaaaaaggaguuaauugggaggcugaggcaggaggauugcuugagcccaggaguuggagaccugcguggacaacguagugagacuccaugucuccaaaaaagacaaagauuagccaggcauugugauacauggcuguggcccuaucuagggaucugcacucuagccugggcgacagagcaagacccggucucaaaaaaaaaaaaaaaaaaaagacccuaagccuuuuuuuacugcauauauuccuauccauucuaggaaaagucaguugucaaaucaaagugaaaaauuguuuucuuuaaagugaagucagauggguagaauaaaauauacugauguuacugccauagucacaauucuaaagcacaacauaauuguaauaaugucacaagcuuaccaagguugcuacaugaaacagaagaaaauuaaauuugguguuauuuauuuuuauaaagagacagcaucucacuuuguugcccaggcugaucucaaacuccuggcuucaagcaguccuuggcuuccacaguguuggaauuccaggcaugagccacccugccuggccauuauuaucuuuaauaacaauuuacaucagccacauuuuucuuuaugguuuuuacuuuugaugucaaacuuagacauuuuuuuccccauuacaguaguguuuuccaguucuuuuauaguuuuacauuuuauauuugaacguuuuauuuaucuggaauuaguuuuguugcauaacguaaggauccgacuuaauuuuuucccaaaucguuggcaaauucuuucaccacucuuuauugauuugagauguuacuuuuauuauauucucauauauauuuggaucuacuuuuggucuuuugugaccuaucucuugacaguggaaucacacuguuuauaucaguauagcuuuggguacauuuuaauacuugguaaagcaaauuuuucugacuuuuucaaaagucgaggauauuuguuuauuuuuccaacugucuuuagaaauguuuuaucugauucuacugaaaagucugcuaauauucauugacugauugauuugauuuggagaggacuaccaucuuuacaguauauaguuuacuaauuaauaaauucgcguuucaucuuucacaagucuucuuuuuugacuuucaguaaaguuuuguaguuuuucucauguguuauauuuuugggugcuauugugaaugauacuauuuuuccacuauauuuucuaaccaguuuuguuaauacauacacagcuuacuaauuuuuauuaaaucauucaacauauuuaacuucuuuuucuaauaauuuucaguuuauucucauaggggauuuaaaauauaucaucuuuaaauaauaauaacuuugcuaaaucaguuuuaauauauucacaauugggacuuaguaauauauggguuugguuaguaguuuuguaucacauaguuuucuuuuauuuugagacagagucuuguucugucgcccaggcugaagugcaguggcgcgauccuggcucacugcaacuccaccucguggguucaagugauucuccugccucagucucccugguagcugggacuacaggcacccaccaccacacccggcuaauuuuuauauuuuuagcagagaugggguuucgccaucuccugaucucaaacucaugaucucaagugauccacccaccuaggccucccaaagugcugggauuacaggcaugagccacugagcccagccacacaugauuuucuuuauagacccuauuuacaaauuuauggucugagguacuggggauuaggacuuuaauauaugaauuuaauucauuuauuaagugcaagauuggugcaagguugguguuugaugauuuccucagucuuuauuuugugaccaccagugaauaacccaaguauuuguguuuuuaaacaccuuuauuuggucaaguaugucucaugucuauaaaaaguuuugaauuuauuuuagcuuaauguuuguagguguuuuuuuuuuuuuuuuuuuuuugcuauucuaauuauuuuauuuguuuguguggguuuagaauagcagaaauuuauugucucccaauucuagaggcuguacuuccaaaaucaagggauccaaaauaggaguguccgcagagccaugcucccuuuaaagguaccagggaaggaucugcuucuggccuccuuccuaacucccgguagccucaggcguuccuuggguuucagauggcaguuuuaucccugucucuccccacaugucugugguuucauaucuagaugucucccuuuuuauaaggaugguauagucauauaggauuaggcccuacccugauaaucucauuuuaacuugauuaccucuguaaagacccuauuuacaaauuuauggucugagguacuggugguuagaacuugaauauaugaauuuaauucauuuuuauuauuuugaaaucauuucauacuuagaaaagauguaggaauaccauugugaaugcccauaaucuucauacccacauucaccaguuuuuaacauuuucccauauuugcauuauaauucucuguuucugucucuucacuccuaccuguacacacacacacacacacacacacacacuuuuaagagugagguuguauauauuaugccccuuuacccuuacuauuucaguuuccuuuuuuuuuuuuuuuuuugagacggagucucgcucugucgcccagccuggagugcaguggcaggaucuuggcucacugcaaccuccaccuccccaguucaagcaauucuccugccucagccucccgaguagcuaggacuacaggcgcgugccaccacgcugggcuaauuuuuuguauuuuuaguagagacgggguuuugccauguuagccaggauggucucgaucuucugaccucaugauccaccugccucggccucccaaaaugcugggauuacagguaugagcuacugugcccagccuucagcuuucauuuucuaaggacauggauauucuguguaaucauucuucaguuaucaaauucagggaguuuaacauugaggcggcacuuugaucugcagucuguauuccaguuuugucaguuggcccaacugagguguuuuuuuuuuuuuuuuaaagcauuuuucccuuccaguggaggauucaaucuggagucacauauugcauuugguuguccugccucuuuaaucuccuucucucugaagcaguuccuuagccaccuguuguguuucaugacaucaacauuuuugaagaacaccaggccaguuauuuucuagaauauuccucacuuugggcuuggcauuuucucauuauuagauucaggugaugcaucucuggccagaagucuacauaaaugacgacguguccuucuaggguaucagaagcauacuaugucuguccuaccugucauuggucauguuaauuuugauuaccuggucaagguguuuuccaguuucucuucucuauaauuacuguuuucccucuuguaacuaguaagcagucuguggggagaaacuucaagaccacacaaauuucuuauuccucauaaaauucacugcuccccugcagauuuaauuggucuugacuauuuauaguuguagaauggugauuuuuccacuuucaucacuaguucuacauuuaucauucugaauucuguaagaacccuucuuacucccuuauguauguauuugauuuaucuauuuaguugucaucacuauggagugauagacuccauuucguucaaugaguuauaguccuuauggauuuuuuucaucagggucucacuccuguugcccagacuacagugugguggugcgaucacagcucucuacagccuucaccucccagacucaguugauccucccaucucagccucccaaguagcuggaacuacaggugcacaccaccaaaccugacgaaauuuuuuuuuuuaaaguauaaauggggguuucaccauguuggccaggcuugauacuccugggcucaagggaucugccugugucggccucccaaaguccugggauuacaggcaugagccacuguaccugaccagcccuuauguuuucugagguucauguugucccagauuuugauagcgggagucucuucauuccggcucucguguccuuuggauauggccuugucauuuuuucuucccuuuaaaaaaaaauaaagagcacuucuuuaugccauagugauguuccaggcuucuauaggaccuucuuugccccauccccagaaucagucaugucucuaaggagcccugguuucuguuagugggauucaauauauagaaaccaagaucugggucuuagguguucucauugauacuggggugucauugguucuagccacuuucaacaaauguaucuaggaaauagacuauuauuuuuuaacauacuaucuuuaaaaucauuuuuaguuuauacuaauacuucuaauucuaaaccaaccccucaggauuuuuuuggccuuuccccaguccauuucauucuaauuucauuuccaguuuauuuuuaauuuaaaaaaauugaaguauaauuuauggauuuguguauuuagugaaaugcauaguucuuuuuugacuuacuuguuuaucugacacagaaucucucucucucauccaggcuggagugcagugacaugaucauagcucauuguagccuugaacuucuaggcucaagcgguccuccugccucagccuccugaguagcugggguuacagauguaugccaccaugccuggcagauuuuuaaauuuuuuguguagagacagagucuugcuauguuggcuagucuggucuugaauuccuggccucaagcaauucuccuaccucagucucccaaagagcugggauuacaggcauaugccaccaugcccaguccccaucuuucuuauguauuccguuuaaucuguuuugacagugcauacgcuucuguaaucucuaucaagauacuguucuauaguugugguuuuuuuuccuuuugagacggaguugcacucuguugcccaggcuggagugcaguggcacugucuuggcucacugcaaccucugccuccugaauucaagcaguuuuccugcuuuagccucccuacaagcugggauuacaggcgcacaccuccaugcccggcuaauuuuuguauuuuuaguagagacgggguuucaccauguuggucaggcuggucuugaauucuugaccucaggcaauccacccaccucagcagaacucauuugggccuguuguuuucuguuuuggaagguuacugcuuacugaugcaauaucuuuaauagauauaggccuauuuggauuaucuauaucuucuugugugaguuuuggcauauugugucuuuuaaggaauugauccaugucaucuaaauuaucaaauuuuuaaucauguuuguucauaauauuccuuuauaauccuuuuaauguacauuuagaagggaucuguagugaucuuuuuuuucauuucugauacuagcuauuugugucaucuuuuuaauuaauuggcuuagcuaaaggcuuaucaauuuuaugaucuuuucaaagaaccagcuuuuaguuuuucuuacugauuuccuauuuucaguaucauugauacuauuauauuuuuauuucuuuuauuccacuuacuuuggauuuaauuugcucuuuguuuucuauuuuccaaagguggaacugugagcuuugguccauucaacuuauuucauguaacgucaauucaccgaaagaguuaagagauuugaagcaauggccugaguuugaauccuaguucuccacucauugacaaaccacuuguccugucugaacccuaucucccauaaaauggaagaaggauauuacuuaaguuaugagauugcuugaaauucaguuacaaugugggugaaaacugauuuuaaacugugaagugcuacaguuuugauauuaucacuuccuuaaauguacaaagauuauuucuuuacaaucaccauuggaauuuugccucaauuuauggucaaacuuugucugguuuucaguuuccagaauuuccaucucucaccugcuacccaaaucaggauggcuaccaaaccugcccaucuucaguaaucuuucguuucucugauucaucacagguuacuuauagggauccaguuaucuucccugaauguuucucaguauuugaauuguaaauuauaauccugucuuggaacaaaagaacuugaacucauauugaguccugugcucaccuaucuguuuugaucuucuuuuauuaugagucguucauucauugugaaaaaucucauuucagugauagggaaggcaaaaaaaaucagucuccugacuuuuuuccucuccuguuuuauuaaaauuauaaaauaugcauaacauaaaauuuaccaucuuaaccauuuuaaaguauacaauuccaguugcauuaaguauauuuacagugucauggaauuaucacuacuauguauuuucagaacuuuuucaucaucccaaacaggccccccucccuuuuuuuuuugagacagggucucacucugucacccaggcuggagugcaguggcacaaucauagcucacugcaaccuccacuucccaugcucaagcgauucucccaccucagcuucucaaguagccgggacuacaggugcgugccaucacaccuagcuaauuuuuguauuuuuauuuugccgagaugcgguuuugccauguugcccagucuggucuugaauuccugggcucaagugauccuccugccucagucuuccaaaguccggggauuacaggaguaaggcaccacacccgaccucuuuuuuuuuuuuuuuuucucuuuuuucuuuuuuuaagagacagggucuuauucugucgucuaggccucagcuccuggccucaagcgauccucuccccucagccuccccaaguauugggauugcaggugugagccaggacgccuacccgcaaacagaaacucuuuacccauuaaacaauaacucuguaguauuccuuccuuccugccccugguaaccacuauaguacuuucugucuaauaugaauuugccuguucgaggugccucauauagguggaauugcauauuugugccuggcauauuucauuuagcacauuuuuucaaggcucauccauauagcacguaucaguacuucauuucuuuuaguugcugaauauuauuauuauuauuauuuuugagacagagucucacucugucucuuaggcuagagugcaguagcaugaucucggcucacugcaaccuccgccucccggguucaagcgauucuugugucucagcuucccgaguagcugagauuacaggcgcccaccaccacgcccgacuaauuuuuguauuauuauuauuuuuuaguagagacaggguuucaccauguuggccaggcuggucuugaacuacugaccucaggugauccacccgccucagucucccaaagugcugggauuacaggcgugagccaacacgccuggcugcugaauauuauuuuauuguguagaguaauguauucauucguugguugauaaggcauuuggguuauuuucaccuuuuggcuguuguuccagauaaugcugcuaugagcauauuuguacagguuuuuguguggaaauauguuuuuguuucucuucgguauauaggaaaagaauuacagaaucaacucugugcuuaaccauuugaagaacugguuuucuuuuccaaaauggcugcaccauuuacagcccugccagcagguuauaaaaguuccagcuucucugcauccuuggcaacauuuguuauuauuuuuuuauuauagccacucaggugggucugaaguauuuugucguguuuuuuauuuguguuuccuuguuacugauaucguucagcauauuuccaugugcuuauugcucauaugcauauguucuuuggagaacugucugagauucuuugcucauuuuuaacuggguuauuucucuuuuuauuguugaauuucaaugguucuuuauauauuccagauacaaguccuuaucaguuacaugauuuacaaaaauuuucuaccauucccauuccuugaguugucuuuucacuuucuugauggugcccuuugaagcacaacauuuguguguguguguguguguauuuuuaguagagaugggguuuugccauguuggucgggcgggucuuaaacuccugaucucaggugauccacccaccuugccggugaaccaccacagcacccggcccguuuuugguuuuuuuguuuguuuguuuuuugagccagaguauugcucuguugcccuggcuggagugccguagugccaucuugguucacggcaacaucuggcucccggguucaagugauucuucugccucagccucccgaguagcugggauuacagguacacaccaccacacccugcuaauuuuuauauuuuugguagagacagaguuuugccauguuccucaggcuggucucaaacuccugaauucaagugauccacccgccucagccucccaaagugcugggauuacaggcgugagccaccacucccggccagaagcacaauuuuuaauuuuuaugauguucaguuuauauuuguuuuucccuuuguugcuuguauuuuugugugucuuaauaugucuucuaagucuguuuuaauggauggauucuccccuuccugccucucauuuaucuguugaagaauuuugccuauuugaccuguagaguuuccuauggucuggauuuuucuaauuauguucccaugguacaguucagcuucucucugucucuguauuuccugcaaauuggcagcuacaccaagaggugugaucagauucugauguucaagggcuuuugucuaucuuacaggcagucaguaugcuauuauauuaggagacacacaaugugugguugugucucugugauauuauuuuaguagcuuugaugcugaaugcugauuaggucuucauugggguuugcaaauguaugauagucuaauucuguuaucauuuguuagcugacaaacuuuuguuuaaauuuuauuuuaaaaauuaauaaaagcagggacaggaggaucgcuugagcccaggaauugaagaccacccuggucaacauagugagacaucauuuguacaaaaaauuagaaaaauuagccaggcgugguggugucaaccuguaguccuggcuguucgggaggcugagaugagaggauuguuugagcccaggaauuugaggguugugguaagcucugagcaugccacugcucuccagggcaaaaaagaaaaaaaaaaacccuaaaaauagagcuuuuggggauauacaguucuaugaauuuuaacacaucuauagauauaacaaacuacaagucauuauacagagcaguucagucaccggaaaaccuccugcuaucccuuugcagucacaccccuacuucaccccaacucuggaaaccagcaaccuguuuccugucacucuaguuuugucuuuuugaaguacccucuugagacuguguuauuuagcauuaugccuuuugagggucauccagguuguugcaugugugaagaguguugucccuuucugugguugauuaucauuccauuggauggaugugccaguuuuuuauucguucacuuuuagaaggacuuacguguuguguccaguuuuuggcgaugaugaauagagcugcucuauacauucauguauacauuucuugcuugcacauagguuacauuucaccagcuaaguaccuaggaaugggauuaccagcauauuccuacagugcuguaugccuuuuaguucuccagggaauaggaaagacaagauacaugcuuguucucuccuuuuacuggcaguuuuuaaaaacagacuguuucuuagagcauuuucagguucacagcaaaauugaagaaguacgaagaguucccauauccccccaauccacauguacauagccugccccacucucaacaucccccacuagaguggcacauuguuuccaauugaugaaccuauguugacauguccuuauuacgcaaagucuuuaggcuucauuaggguucacucuugguguuguacauuauauggguuauauuauauauuaaaugcagagugaugucuauucaccauuaugguaucauagagaauaguuucacugcccuauaaauccucugugcuuucugccuauuuaucgcucccuccucucaaccccuggcacugaucuuuuuacugucuucauaguuuugcuguuuccagaaaugucauauaguuggaauuguaacaauuuuaaaaauaaugaauuugguucccuaucuucucugaaggugauuuucuuuccuuuuuguuuuuugaauuguuaugaacucauuuguugggguucaguccauuguaauucuuacaccuguuaaagcucaaauuguucguuuuuggccaagggcagccucuucugguaggcuucugaguccuucuaaagugacucauagucugugauuuguccccucacuaccuuauaaaaugagacuuuccgggaacaucuuuuacaauuucugccucacaccuggaauaucuccaagaagccuuggguuuuuuucagugggaaaugguauuucaaaaccacugccaggacuguugggguguucuaaugcuuauugcuacugaguuagucuucguuucuaauucuaaguggauagugcugggagguacuacccucggaauccugguuuucaaggacauaggugugguagaauauuugauaauuacucguuuauuuugucacauauuaugucucugacaguuacaaaacaacaauacuaauauauccaccauggguugaaaccaguuaaaaccauucuuugcaugcgcucuccauuuccccccauucccugugcaguugucuuccauauaucaccagggcauguugccauuagaacgcacacccauuaugcgcccuuguauucuguuccucuucgucccuguguagucgacagguaacuauuuagcgcucaccucuauuccuaugucaguaucccucuaucuacauggguucucucaaacucauuuucuaguagauaucucuagaagggcuuaugggaacaauauucccugaguuuuuguauguugauaauauguauaauguuuauacucgaaaguucuacuggccauaaaauucuuggcuuucauuuuccuuccuugaguauuuuauuuucugguauaauauguugcuuuggaaaguuuguuguuaauguaguuuuuuucccuuauaaauuacuugauguuuuugccuagaugcucaaguuuauuuuuuccuuaaaaauccugcaauuuuacuauaucuugguauugauuauuuuggcccaguauuuuccaguaugcaaugugugccuuaaauauguaguuucuaauuuuuuucugguguccuggcaugucauccaggcuggccucuaauuccugggcucaagugauccucucgccucagcuuccccaaugcugagaguaugggcugcauuagcucuuuuuucuuaauuuuggcaaaaauuucuuggauuacaguuuuuaguguugcuuguucuccugcuuuugcuuucuccagggauuccuguuauauaagaaauaggaacaauuuuuguugcuuucuuuagaauccuauuauuucaucauuucguuuuugguuuuuagaauuaucuuccuucuuacuuucaauuucucgaaggcauuaucuguaauauucauucuuguguuccuuggguuuuauucuucauuucucaaauaaauuuuuaaauuucuaauuacuuacugagucauguucucacauuucugaguuucuucuguucugauguuguuuuucaugcuuuauauaauuuucuuaauguuuuuagcucauuuugaaauacuaauaguagguucuaauuuuaaucuccuuuguguuucuggccuucuagcaugauguauuugucuguaaggaggauguuguuuuguuguuuuguucccgauuccuucacuguuuuuuuuuguuuguuuguuuuuuugagacggagucuuacucugucgccugggcuggagcgcaguggugcuaucucggcucucuacaaccucugccuccugaguucaggcaauucuucugccucagccucccgaguagcugggacuauaggugcgcgccaccaugcucggcuaauuuuuguauuuuuaguagagacaggguuucaccauauuggccaggcuugucuugaacuccugaccucguggucugccgccucggccucccaaaguacugggauuacaggcgugagcuaccaugccuagccccuuccccauuuucuuauaauaacuucuaugagauuuggaucugaaaacuuugccaugggucaguuuuauuggaaguucauuuuccugaauguuuggaagaaagccuagugacucaggauagcauuucuaauuucacagaguuauuuuuccguuaugaaacacagauugccuuugaggucuccuguuucuacuacugccccucacuuuuaugugggccuccucuuuccuuuguuucuggagaaccuuuuccuguucaauucuguuuuaauuuucagcaguuuuuuuucugugugagugaggcuguuuccuagcagggaggucugguuggucauuuucaaguucaucagggcuucaucagggcuuguccacuucaacccuuacgcuauaggcccuuugcaccaucugcaucuucaaaugugcccacuguucguuccaaugaagacuuguuuguuauuuggcuuguagagggacauggaagaagcaaaucagucuuuaccucucucaaggcuggagauuugcaggcacugguuuuaucuguaacuggagaugagaguucaggccaaacacugguuuaaaaaucuguauaugaaauagcgauacccuggaaucuaggacugagauccugugccucacacccacccacgcggccaagugccuaccuguggcagugacuucuuagugcucguccacaucuaggucuucuuuagucccaggcugaugggaacauuuaauuccuuugcuccuugauguuagaugggaucaggugacugaugcuggccaguggacuuugagggagguuguguuacuucugaguuggcauagugaaaagcccaugaagaugcucugcucucuuucuugccuaggauaucccuggucauaggauucauuugaugcaggaacaagguggucagccuggcucuuugaauaacuggaaauggccccugcauacccguguuggacauauuacaugaggcagaaauaaauuucuguugugcuaagccauugaaauguugggguuguuaccacagcaucacuuagaccugugcugucuaacauggcagccacuaggcuacauguggccaugagcacuugaaauguggcuaguccuaauuaagaugugcuguaacuuuaaaauaauacuauauuuggaaaaaaagguguaaaauaucuuaauaauuuuuauauuacauauuaacaucuuguauucauuggguuaaauaagauguauugaaauuauuuucagcuuucucuuuaguuuuuuucaugaagcugcuuagaaaauuuaaaauuauacacguggucacauuuguggcauuauccgcagcacugaccccuaccuuaguaauucaguaccccucccucauuuugacaaaagcuggucaguugauugucagagaaacugaaucagugaaacuccagauuugaagagaguacagaagaggaguacacuacagauggggauuaagcgaaagucgaccuacuggaucaggagauacacuuccuugucuuuaauuucuguccauguccuuuuuccacuuguuugcagagcacugacaauuggaguuauacacuucaccuaggagacugaaggacucuuuucuaagaaaucgaauggcuucaggaaagagaucaacagagcccgauauuuaaggcucuccguaucugcacaagcaggaguuacccugcaguaaagccugcuaguucacaagccucaccuacaugcagagaggguccaguugggguugacgaaccacucuuuaugggaacagcacccaagauacaccagacacugguggaaaauucuaacaggaauuaacuuguuaagggaaagauaauaauaauaugagucuaugugcauauuaucagugaucuguuugcauauuaaauaauucagauaaugaaaguacaagugaaaaaaugagucuuugcgauaaagcucuucuccagccauccccauuucuacaauauuuuuuuccaauuuuuaaaaucaagguaaaauauacauaccccaaauuuaucauuuuaaccauuuuuaaguauauaguucagugguauuaaauacauucauaauguugugcaaccaucaccaccauccaucucccauacucuuuucaucuggugaagcugaaaauauacucaucuuguaaagcugaaauaacaacucucccuucuucccuuuccccauccuuggcaaccaugauucuacugaugucucuaugaucuugacuacuaaguacgucauauaaguggcaucauuuaguauuuuucuuuuugguggcuggcuuauuucacuuagcauaaugucuucaagguuuauguuguggcaugucucagaauuucccuccuccuuaaggcugaacaauacuccauuguaugcauauaccacauuuugcuuauccauucauucauccauggauacuuggguuacuuucacauuuuagcuguugugaauaaugcugccauuaacguggauaugcaacuaaaagaguacuguaaacaaaugccaacaaauuggauaaccuggaugaaauggacagauuccuagaaacacaaaaccuacuaagacuaaauaaugaagaaacagaauaucagaauagaccuguaacuagugaggagauugaaugaguaaucaaaaaucuccugacagaaaagaaaaacccuggaccugauggcuucacuggugaauucuaccaaacauuuaaggaaaaacuaauaccauucuucaaguuuucaaaaacaaaaaaaacuggagaaagagaacccuuuccaacucauucuaugaggccaacaucacacugacaccaaaguuagacaaagauacuacaaggaaacuacagauaauacuucuuaggaacguugaugccaaaaucuucaauaaaguacuagcagaguuuccucuaauauuuuaagaaguuugcugaagugugaauaguucuuugauuaauauuuuuucgagacggagucucaccguguugcccaggcuggaguguaauggcaugaucucagcucacugcaaccucugcuucccggguucaaacgauucuccugccucagccuccuaaguagcuaggauuacaggcaccugccaccaugccuggcuaauuuuuguacuuuuaguagagacaggguuuccccauguuggccaagcuggucucgaacuccugaccucgugaucugcccuccucggccuccaaaagugcugggauuacaggugugagccaccgugucccgccagcuaauaauuuuagggagcagaugaagaggucuucagacugcuuuuagcucagguuuuuuuguuuuaaaauuuauuaaguggaaagaaacauguuaacugaagauugaaguuugcugaaguaugaauaguucuucgguuaauaauuuuagggcgcagaugaagaggcuuucagauugcuuuugucucaggauuuuuugcuuuaaaauuuauaaagugaauggaaagaaacguuaacugaggauuagugcuaguuuuucuugacaggucauuuccuauagggagggcaguaguauaagcaaaacaacaaaauauucaaaauucucaaauaaguacuauuuauuauugaaaaacucagauaaauguagaaguuauuuuuucucucuauugagcagcaguuacauaugcuagaaucauaguuugaaugauucagacuguguaccugugaucugacauaccuggauuggaguuccaucucugccacccacuuuauuugacuccauagagaaauuacucaagccccuuaagacagacacugaaauaggauacaguuuccaagaaggcaagauuuuuuggauuuuuuuguuguuguucauugcuguaugcugagguuuagauuaguuccugggacacagaacuagcagucaguaaauacguugaaugaacccgaagaauuccugccuccgaauuguuuuggggaugaaaugcgguaaugcauguaaagcauugggcaugcaagugaagccagccacguauuaaacaguacucagcucuuaccucuguaucuuauauucuuauuuccgugacuguauccucacacaugaagaaauggcuacuuauuuauuauuauuauuacuauuauuauugcuacuuauuuuuuaaagccacuuacaucucuggagaucucuguauguguguuaaaaauaccauguuuuguaacaauuggcuugucuuagaaaacuuuucaauuauacagaauuugagaucuuuacaacuugaauuuucuuuuuuuucuuuuugagucucgcucugucucccaggcuggagugcaguggugcgaucucaggucacugcagucucugccuccugggcucaagcgauucuccugccucagccuccugaguacaggcacgcgccaccaugcccaacuaauuuuuguauuuuuaguagagaugggguuucaucauuuuggccaggauggucucgaucuccugaccucgugauccgcccacuucggccuccccaagugcuaggauuacaggcgugagccaccgugcccggccacaacuugaauuuucauagcaaacuaguuuuuauugucaaauuagaaauuuaugcuugaagccuagugcuucuuuugccuaugcaucucaucuaaaaguaauggcacuuaucacgucagccucauggauugugguagugguuguuauccuuggaauuaccgguaggguaacagucuccaggcauaccauggguucuucaguuaugaguggcauagcuuauguacauguuaacugugaauaauaaacgauuuuuccaacuuacugcaauacucuuauuuaugucuguaaugugaauuguccagaggagaaguuguggucaauugaugauuaggcugaugguuucugcuagcucuggcaaaaggugaauccaguugcuuucuagcacuuuuccuacuaacccugcuucucacccuguaccuaauaccacauuuuuaguuuaguuuuuguuuuguuuuguuugagacagggucuaacuuucugacacccagacuggagugcaguggugugaucauagcucgucugcagccuccaccucccaggcucaagugguucucucaccucagccuccugaauagcugggacuacaggauuaugcccccaugccuggcuguuuaaaaauuuuuggguagagaugggguuuugccacguugccauggcuggucucaaacuacuggguuuaagcaauccucuugccuuggccucccaaaguguugggauuacaggcaugagccacugcacccagaaucaccuuuuuuuaguuuggaagaugacaucuuuuuuuuuuuuuuucuuagagaagcuagaggguaccaaauuaaagucugucaguuuuuucugucuccaccucaaagaucacuguaugacuucuuuucuuccuucucggcuguuucacacgaaguuuucccuuuuucuaaggcucaguccuuaucgucugagaccucccucucauuauccaucucuccauccuugacuguuucuaguucgauuguaacacugaucaaaucuccuucaaguucaaaacaaaccagcaaaaccuucccuugauacugccauuaccucagagcuauguaccgugcuccuugcccuccccccggacuucuccggaugcuaguugaugccuguuuagcaccugucacuguuucauauacuucuuacuggccacugccugguuggcaucuaccacuucucuggaaucagcaaccccaauagcagauuuaacugcugguuccaugguuuuuguuacuuguccuuuuuugcaguguuuuaaauaauaaucaucuuuucacuuauuuuuuuaaagaaggucauuuaaaaaaaucauccugcaguggaaaauuuggaaaauauggaaaaguauaaagaagacaauuaucaacuguaauaccagcaguaccuauuguuaagcucuagggcaugucauuuccaucgcucucuuuuuaaaugcauuaaacagaaaaggaucacaugguuauuuugugaucugauuuuuucuaucuuaauauauugugaguauauuuccaaguacuuauucucguguggcauaacauuuguaguuacacgaaguggcgguguugagacugccuugguucaaauccuggcuucaguuacugcugcagugugaccugaaggaaguuacuccucuggguuuuaguuuccucaucuugaaaauaguuauaacauucuuacuaacuucuaggguugcuguaaguauuaagugagcuaacacauagaaauaauucuuggcacuuaauaaacaucagcuguuauuaacaauauugucugacuguacuauaauuuacauuauuuuuguuuuugcuuguucugccgucauuaagcguguuguaagaccauacgugucacuaaaucugggugcacaacaugauuuuuuuuaaauguggauuuuuauuaguaggauugcucagcuaguggguacaucaugcucauugcuaaguugcucucuagagaggcugcauuuauaccucccaaggcuguacaggagaccauuaacuucauuacauuuuuccaaaaaacuuuaugcuauugcccacauuuugugcugcucccuugcuaaaagugaauaacaauaugaucauguuguuaccucucucuugccaaaacguugacuugaugauaaggggaucacugugacaucaucauuacccacagauguuucuuuuuucuccccccucccccucucuucuccuuccucccuccuuuuguuucuugagacggguucuuggcucugugcaggcuggagugcagugacacaaucauggcucacugcagucuggaccucccaggcucaagugguccucucacuucagccuccugaguagcugggacagcaggcacgcaccaccacacccagcuaauuuuuguauuuuuuguagagagggguuuuaccacguuccuaggcuggucucgaacugcauguucccaggcuggucucgaacucgugggcucaagcgauccacccaccucggccucccaaauugcugggauuacagacccgagccagcaugccuggccucacagauauuucuugaucuacauuuuauucauuauuuagguccaacuuuagcaugugucauguauuuauauacagguucuaaaucuuuccauuugaaaaauacucauuuuucuauccaaaaugaauucaauuuuccuuuuuauucuagucccagucuguguaugaguaaaaccccaaggacccuguauccugauuuuacuauuuuuuguuaaugguuugaaacagcuuuauuaagauauaauucacauaccauacaauuauuuaaagggcacacacuucaaugguuuuuaguauacucacggaucuguacaaccauuaucacagucaugggcaauugguucaggauuugggaagaaaacguauggcauuaggauuaaaaguacaauguuuagagucuggcugaucuggguuuaaaucccaaaucuaccauguauuaacugugugacuuugagaagguuacuuaaucacuaugagcuucaguuuucuuuuuuuuucccguuuuuauuuuuauuuuuauuuuuauuuugaggcagagucuuacucugucacccaggcuggagugcaguggcgcgaucucggcucacugcaaccucugccuccuggguucaagugauucuuugccucagccucccaaguagcugggauuacaggccaccaugcuuggcuaauuuuuguauuuuuaguagagauggaguuucaccauguuggccaggcuggucucgaacuccugaccucaggugauaugcccgccucagccucccagagugcugggauuauagaugcaagccacugugccggccugagcuucaguuuucuuaucuguaauaugggauuacuagugguaucuggcucauaggcuuauuuuaaggauuaagcaagauaauaaauguauagaauuuagcacaguaaccggcacauaguaaauguuugauaaauggaacucgguaaauauuauugccauaauuuuguucuuaaaucaaccagcaaguguuugaugcuauuauuaggcaauguuauuaaauaauggaagguguuucuaccagugauucacaguguuuucuguauccagcaagcuuuuaauacagcugcuuguauuauucucccguauaaacuucuaauuacucucugaaaauacaguugguuuccuguugauagagaacaauaacaguagcuuacacuuagugcuuacugucugccuggcacuguucuaagugccauaccuauauuaacuccuuugauccucauuuuacagauuggguacggaggagguuaaacaacuuggucaaaggauuacaacaguuaagugguggagccaggauucuaaccuugguauucagucuggcuacagagcccaugcucuuucuuaucuuuauguucuucucuuuacuuccuaaagaaugguagaugcauuucaaacauccugacaucuuggcugcugaggauucuguauggaaaagcacuaugaggucuuuaaugcuugguuggaaggagaacuaaaaugagcaguugugugugcugugggcaugggccuuagggcagcuguauauuugucaucuggaucagaccauacauuggugauccugcuucacaaccauagaauccagacccuccauggggccaugaccagccacaaaguauccucccugacccucccuguggaaugcucgugugaacuugcacuacucccuccuugcauaguaucaaauccugcggauccuuggaaggccaccuuaaauuacuucccaccugugaagcaguaaacguuagugcucuucgguuaaucaucauguguggugguaugacauuugcaguaucaucuguuaccauuauuuaaauuugaauaucuuuaugucuuggcuccucauguugauuacauguuucuugcaggcagggaacuaugucuuaaauguuuuaaaauuugcuuuaauggccccuggaaauauuaccaaggguuguguguguguguguguguguguguguguguuucuuucagucucacuugucugucgauaauagaauaucucugaaauucaaacauaccuagccucacaaacuuagucccaaagguacaugcuguguuuuugcaagaaggugggcagucccuaguuggcuguuggauuaugugcauuguguugggguaguaguugcugcuaauugccugucugcagcuccucagaaccuguuguugcuuccuuuugaaaccuuccuugauugcccuaguugcugcucauccugcauccaggccccucccuuaggcaugugacucacggauuuaaaagacagugcuguacgguaauuaacuaccugccucucaucacacagagaugagaacuuaaauguaggcuucccaucuaaaacuuucuucccuguguguuuauccacccacggacauggagcagcgcugucccacaccuggccuuuuggaggaaauauugcuagacuuauuucuccuguuugaaaucacuaguuggcauauucguguacaagggauggauuuuacaugggugcucuuaauugaaaauaauuuuauuuucuguaacuucuagaauuuuguuaguuuauugaugcacacauauugggugggugacaguuggguuuuuuaugaagauaauuuuaaguuuuuaguaaauaauuaagucaaguauuacaugacaguuuaauuggacuaaauucugacauaaccuauacauccuuaaggugaccggugguuaucauuuucuaugaaauguaauuaguuuuucaggaaacuuuguccacauaaaggaauugauuccacccuuacuaccugcuuagcaauccugaaaaauauuguaaauauaaucuuagaguaugcaucauuaggaaauaaaucuauuuugagaaauaaauuuuaacguacacuauuaauaggacauuuagaaauguaauuuucuaaauauauuagaaauaauaggacauuuagaaaugacauucuuuuuuuuuuuuuccuugcuuuuuguuuguuuguuuguuuuaagacagggacucacucuguuuccuaggcuggagugcaauggcgugaucauugcucacugcagccucaaccuccugggcucaagcgauccucccaccucagccucugaaagugcuaggauuacaggguuagccaccagcacccagccaagaaaucccauucuaauguauuaguaugguuuuaucuauuuuagcaguguaaaauaaagucuuugugaauuauauauaguauaauugaauugccaaaauaaacauccuugcccucaaauugcuuaugauauuguuucugaagcacagacauaaucuuuugaccuuuuaagcaaaaaauuaauuuuucauuuaacuuuuuuuguuugugugugugugugugugugugugacagggucuugcccuguugcccaggcuagaguauagugaugcaaugaugguuuacugcagccucaacuucccaggcucaagugauccucccaccucagccuccugaguaauugggacugcaggcacgugccaccauacuuggcuaaauuaacauuuuuuuguggaaauauggucuugcuauguugcccacacuggucuugaacucacgggcugaagugauccuccugcuucagucacccaaaguacugggauuacaggugugagccaucgugccuggccuuucauucaacuuguaauucacaauuuccagaaaaaaaguuuuaaaauuacugauggaggaaagaucuuugggacuugcuuguaaauauguuaauauuugaucuuaauaagcucugucauacuaacacuguuuauuaaacuuugugguagaauuacuacccauaacuaaagaaugaaaugcauauauuugcaaauuguuaaaaauuuauaaaucgauagaaaaguugaaugaauagugaacacccuugugucuuucacuaacucaguggcucacuugcuaacguuugccucauuugcuuucucuguuuauaaagacauauauacuuuuuuuauuccccugagccauuugaaaguaagcugcaaacaucuugacauuuaacuucuaaacauuuuagcacguguauccuaagagcaagguugucuuccugaagaguuacauuaucauacuuaagagauauaguauuaauacaauauuaucuaacaugugaucccuauuuaaauuucauuuauuuucuuccccagaacaguucuuuauagauguuuuaauuuuugauccagaaaccaagggaaaaaauauaucuauaucuauagagagcuaaauagaucuauauuugauccagaaaccaaucaaggaaacacacacacacacacacacacacacacacccgcuuuuggcugucauauuucuuuaguuuccuuuacuuuaggauaagccacuaccccaccuccaucuaccacccggcaguggucuuuuaugaaaucucaucauauuuuuccuuuucuuauauaagcagucccacaauuugcugguuauauuucaugccuagauuaaaauaagaauauuuuggaaugaauauacuauauagauggcauuaauuuuccauuauauuacauuaggagaaguaauuuuuuuuacauguuuuuuuuccgcuguauaauaguuuaguauuuguuuuaauauacuucuguuaaagauuugugauacugugucuuuaaauuucaaaauagaauuuuguaauuuacucuuaauuuucuuaguauguuguauuccaaaauuauagaaagugcuauaauagacauuuauguacauuacauaaaguaauagacauuuauguaaugugggcauagauuuaaauuuuuuuuaaauuguuaaaauauuaacauuuaaccaugucugcuuuagauagguuuaaucuuacaaggaucuaucuacuuaucuuucuaucuauuuauaauguauauauccauuuuaaauaauaauaacaauacaugaauaaaucugguccaaacuucuaucuugagaaauguaacagcaauuuugaacuccuucaucccucaagacaauuauuccucccuucccagagguaaccauccuccuaaauuugaugucauucccuuaguuuuuucuuaaguuuuaccacauuuguguugucccuuuaacauacuuuuuuuuuuaagcuuuuccuguuuuugagcuuuauacauauggaauuauucuguauauauucuucuugggcuugauuuuuuuauuuauauuacaauuuugagaugucauuuauguugacauuguuagccgaaguucauuaauuuuucacuauuugauauaauauuccaaauuacuggaauauggaauauucuaugaauauaccacaguccauuuuacugcugcuugacaccucgguuucaccuaguuuuugguauggaaaaaauacugcuuuaaauauucuuuugcguggcucaugguagcuaaguacaaaagguucucuagguuauaugcauagaccuggauuguugagucuuggguguauacaccaucagcuuuacuagguauggcagaaugucuucuuuuacacaguuguggaauaagccagaugaguucaagaggagcaaguuugugagaggauggacaagugaguuagugaguuacauuucauuuguuuugaguuuuagccuauuuaguuagaaauguuaaguaggcauuugagauguguuuacuuuuuuagcuccacccaucuuuguuuuuuccuagguugacucauucagguaugucaucucucccuucuccuuaaaguggccuuuaaagaaaaaaguugcaggccgggcacggugguuuacaccuauaaucccagcacuuugggaggccaaagagggcggaucacaagaucaggaguucaagaccagcuuggccaauauggugaaaccgcauuucuacuaaaaauaaaaaaauuagccgagcguggugacacgugccuguaaucccagccacuugggaggcugaggcaggagaaucacuggaccuagggagguggagguugcagugagccgaaaucgugccacugcacucuacccugggugacagagugagacucugucucaaggaaaaaauugcaguaucaugguacaacaauuacuugaucguaauagaagauguguucaguuuuuauaucuucagucucaggccauccgucauaugcagccuuuuuguuuuuauagaccuugaaccacagaacuacauuaagcuaguuugcuguuuuccagggaugacauaaaggagaaguggguagagggugaugcuguuauuagcaagugugcauuccagguagcgguucacaaaggggaaaaaacguaaaggaaagacgggugcaagcuaaaacaaauaagccaguaaguaaaaaaccacaacacucuuuugugauuauuuagaucugaaacaaauagcagcauguauuaauagucccugaugauuucacuguauuguagcauaacucugguauucauaaugucaauucugaauuucuuuauguguugagagaguguaaucaugcugauuuuagcagaucuggugaacccuuagcaaucuagaaucacucucugauaauuccugaauuaacaguagaaauuuaacuguuuuauguggugaaauuauucuaggaagcuuguuccaugggacauuuaccuauuagcuaauaaaacaaauggucuauugauaauuucucaaaagcucuguauaaaaaaaaaauauauauacaauaauuucucuacuggccgaauuggauuuacuuggaaaaagaaagaggguguuaucaaaaaauuuaaaugucuuguuagguucguaaguuguagaacaagaaugagaaugugcaaguguuuuuaugcuucauuguugggaaggauaaauugcaaaagaacauagagcugggugauuuucugggguucagucuguugcgggugccacagauuggcacuccccucggaauugccacaccuucacggagccagaacaggagggauacggagggaaagggcccuuucccaacuucagacugagcacccagaaguugaccugggacugcuguuuuguuucuaggaaacuagaaaccuuggcagaauugaaauuucguagugauuuuuucuucuuugcucuccaaaaaauaaacuuguauguacacacauauguauauacacucacaccuacauaaaagaaagauaauuucaaagaaauaauauaucucguauaguccuugaacaguuauuuuacuauucaaaguagguucuucaaaauuuuuaauuugaaauaacuagguuuacaggaaauugcaaaaaauaguaaggagaggucccuugugccuuucaccuuucccuuaaugguaacuucuuacuacccacagcacagcauuaaacuagaaauugacauugguacauuuuauguguuuagugcugugcuguuuaaacauauauguaguugauuugugaaccacuguggcaucaagacacaaaugcugccaccaccaagcucucccuugugcugcacacaccugccccauggcagccaguaaucugcuuuucaucucuaugauguugacauuucgaggauauuaauaaauggaaucacauaguaugugaccuuuuaaaauuagcuuauuuucacuuggcgcaauuccuugagaucuauccaaguugugugaaucaacaguucuuuccuuuuuauugcugaauaggauuccaugguuuguuuaaccauucaccuuuugaaagauaaucucuuucccuaguuuuuggcuuuuaacaguaaagcagcugugaacauucauguucaguuuuuuguguggacauaaauuuuuauuucuuugggagaggugcuguuaaagaaaaaaaaauuauucagugacacuuguuaaagcaugggaaggaagacauuauucaggaucaucccuguaaguguagggaccacuacaauagugucuuacaguggguggggagagagcguggccucagugcuggauguagcauggggaagugggaauuuguagccaaggagcugguugagggccaguggauggaaaauucucaagaggaaaugucagguguaagggguuucugccuaaacugaccguaacaggauucuuucuugcugaagacaggccaaggugaucagacaucagcuggaggguggcagaagaagaagaggguaaucagacaccuugacgggagguuugcuaaucuggcuuagcaggguucuuugcuaaaacaggaauuuacaaggaaguacacagauaggccugggagaaaaguucaggagccuggcucauuuggucaagcaaagaaucuuugccagagcccaggggugugcaguugguggcuuaccuguaaguagcugugccauuuuacaugcucacuggcaguguaugagagauccaguuucuucacauucguguccacauuugguguugucacuauuuuuuuauuuuagcugugccaguaggugugcagcauaguuugguuugcguuucccugaugucuaguaauguugaccauaucuuuucaugcgcguauuugccgucuauauauccucuucaauaaaaugucuuuauauuucuugcccauuuucuaguugaaauuuuuuucaauuguugagcuuugagauuucuuuauauauccuagaugaggcuuuuaucacauauauuguuagcaaauauauuuuccuagccuguaccucauuuuuuugccuucuuaaacaggucuuuuguagagcaaacauuuuuaauuuuguugaaguucaguuuaucguguuuuuuuuucuuucauggauuguauuuuuggugucauuccccauuccccauuccccacucuccagccccagacggccacgaaucuacucucggucucugugaaauugccuauucugaauauuuccuauaaguggaaucauaugucuggcuucuuucacuuagcauauauucaggccucaucccuguuguaucaugaaccaguucuuuuuauggcuucguuuauuuuuaagguugaauaauguuccacugcauggauaagaccacauuuuguuuagccauuugucagcugaucggcaauuaagguuguuuucacuucuucgucugcaucaguacagcugcauguguacccuucagcccugcaccuuccuuauacacgaugcacagauguacgcaugcgaguacuuguguguacgguuuuguuuucuuuuuuaaauaauggaggauuaacuuauuuuauaguuuuuuucuucgauauuugggaugucuuuuuaugucuauauaaaaagauauaucucauuauuuuaaaugacuauguaguguuuaaugugacugcuuaauugauccuauucuaauaaacauuuagaugacauuggguaacuucuuguuuuucuuuuuuauauaacaguggcaccaggcacagugguuuaugccuauaaucccagcacucugggaagccaaggcagaaggaucacuugagcccaggaauuugagaccugccugggcaacauagagagaccuuauuucuacaaacgaacaaacaaacaaaaaauuauccaggcuuguuggcacuugccuguagucccagcuacuuuggaggcugaggugggaggaucacuugagcccaguagguggaggcuacagggaauuaggauuacaccacugcacuccagcuugggugacagagcaagacccugucucaaauaaaaaaauagugacacuaaucauccuuguacaagugucuuuuuuggugcauagcucauuuuaccuacuuuuggauuuuucucuucaaugccauuugucauuaacuuauuuagaaguguauugauuaccuccuauaggccaggcacuguacuguguaucagacacuagggacacaagcacuaguaaaaugcuauggcuauacucaaguuuuuuguaaagaugauauaccuauaaguagguaaucaugguucacugugauaagugcacaauguguuauuacuagaauccuguggaacgaacuguagcagaagguaaggcagguuacguuaaauagauugaaaacagauuauagcagucugugaaugcccuucuaaugaauuuggacuucauuuuguacauaauuagaaaucauugaaaaaggccgggcgcgguggcucauaccuguaaucccagcacucugggaggccuaggcgguuggaucacgaggucaggaauucgagaugagccuggccaagauggugaaacccugucucuacuaaaaauacaaaaguuagcugagugugauggcacaugccuguagucccagcuacuugggaggcugaggcaggagaauugcuugaacccgggaggcagagguuguggugagcugaguucgugccauugcacuccagccugggcgacaagagcgaaacuccgucuaaaaaaaaaaaaaaaaagaaaucauugaaaaaauguaggcacacuuaaauuuuuuaacuuuaguaaauuuuugugcugugacuguuuuagaacacuuuaucaccucccacaaucacugccuucuaccuccucaucuaggcaaccacugcuuauuuucugucucuaaauuugcuuuuccuaaacauuuaugcguuggaaacauacaguaugcaguauuuuuacauuggcuucuuucaucuagcgugucuuugaggcucauguaugcuguaauguguaucaguauuuugugccuuuuuacugccuaaugauauuccauucuguggugaugacaauuuaugugcucagcaauugauggauguuuggauuguuuccaguuuuugguuauuaugaacaaagcugcuaugaacaucuguagauaaaucuuugugugggcacauauuucucuugggaaaaggaaauuuuggauccugugauaaguuuauauauaacuuuaagaaauuagggcaugguggcucacgcuuauaaucccagugacucgggagacugaggcgggaggauugcuugagcucaagaggucaaggcugaagugagccaugauugggcuacugcacucuagccuggacaacagagugagaccucaccucuaaaagaacaaagaaaaaaaauuuacagacuauuccucaaagugacugcaucauuuuacaguccugucagcaauguaugcggguuccagcuucuccagaugcucgacacuugguauugucuuuugauuauggccauuuuaauggcuguauaguguaucucauuguaguuuuaacuugcaucuuccuaaugacaggguguuuauaaucuuuucaugaagcauaguuauauuuuagagacaugaguccaaugaauagagguaagaauggaggugagcuacaugaaagaugagagccuacgucagacaauauguguagagauggggagacauuuuaaagauacguguaucagagcuagaaugagcagcauuuaguaacuccugaguauaauagaugaagcagagggagguggggcuugugaucccaagauuuuaaacuucggcaauugggcacuuuuuggcuaacggugcugccauuagccaaaaagugacugccgguacauaaacagauuuugugcuggugguugauggcuuuuauauugaucuuauucucuugaugugccacuggaauaaacauuuaauagaguguuuggaaacauguaucuaguucaaaagaaggaucugggcugagguauaaauuuagggcaguuuacauuguguagggaacaacuaaauucauggaaguaaaugauguaucuguuccuaagucacccuaucugcugaguuacuugugacaaauuguuuaaacaguaaaagaauuuaauaugaaaagauacacguuaagaugauucuaggauuaauucauucaggcaugacagcaucaccaaggacccagguucuuucuaucuuuuaaugcugcugcuguucuugaucuguuggguuguccucaugguccaguucuuguuuacacauucaaacccagaauugcaugcaaaaaggcugggagcauguguuuuuaccugggucuuuuuucaucagccaagaaaacuuuuccuaaaagcucccuagcaaacuuacuuucuugucuucuuggccagaauugcauuaggaauguguuaccagacuacccacuggcaaggggaauggaaauugucacaguugguucagaccagagcuuucuagcccaaguauuuuuuucuguuaucucuucuggaagaagccuuuuccccuugccuuuugagucucuucuguaguucagguaaguuagauuuucuaugcaacccaguuuuguaucauugaguuguuacuauucaauacuucacaacagcaaauacuugccaaaauccuacacugugucaugcuggauucuaggauacagaaaugaauaagaaacuuguaguuugacauagauacaagcuuaaacagaagagugcuaugauagauuuguacacuaaaguucuuuuggacuauggauuuaguacaacuguuuauauguuugguuuuaugaguaaaggcaucuugaguuucaaaaucaaccuuauauucaauuuauaaaugaaguuuuggaaauuuagaacgcaacccauucaugaguugacccucccuuucuaguuaggugguuacauguuuauuauaggggugcaugguauacuauccuaaaguaacuguucauuugaguuauuuacagcuaaaaccacauuauguuuuucuggagcauaauguuuguguuuucuaguuaucguaccaaaguaaacaguaauaucuuuagcuuaagaacccaacugaaauguuuguaaaauauagauuguuuuguaauuuggcucuuuuuuuuuaaugguccuaugaaugcaacuauaguguuugcaguauuuguacagugcauggggugcuuuuucugggugcugagaagggaggagaaaugauagggaagaggggauuuggaguagccgaaggaaaaaaugugcaaucaguguuguugauuccaccgaauucuaagaauuccauuacaucuugauaucugguacaagcucaaaguuaaucuuaaauuuuggcuuagggcauggccguacuugcuggcuacuugggaggcuaaagcaggaggauccuuagagccuggaaggucaaggcugcugugagccaugaccgugccacugcacuccagccugagugacagagugagacccugucuuuaaaaagaaaaaaagaaaaaaaaaaaaaacagaaaaaaaacaaacaaguguccaggagugguggcucacgccuguaauccuagcacuuugggaggcugaggcgggcggaucaugaggucaggaguucaagaccagccuggccaacauggugaaaccgcaucucuacuaaaauacaaaaauuagcugggcaugguuaaucccagcuacuggggaggcugaggcaggagaauggcuugaacccaggaggcagagguugcagugagcugagaucgugccacuguacuccagccugggugacaagcaagacucuguaucaaaaaaaaaaaaaaaaaaaaaaaaaaaaaaaaaaaaaaagguguuuuggccuagauugaguaaaagaauauuuacacuauucuuuucuguaaagcaaaucuuacuaauaauagaaaucagugggugacauucugaaaccuuauagauaacuguuaugauauccauaaucagugcuuguccuuggauucugcauggguagugagcuuuaaaguaucuuguugguuuaagauuuaaccauuuuaauaauuuugaaaaccaagauggaugcauacauucugaugacaagaaaagauguuuuguaagggaaauguggaauuaaaaugaacuuuuuguguuuguuugcaaauaauuauuaauguugaagaaauuuugauguuagcucugaguuaugaauguuagaauauauuuagaaauguuugauuuucauuuuuccaugucauuaagaagcuugcauauguuuuuuaaagaauugccuucuuuuuaauguguuuucuacaacuaauaggcuuagaaauuucagacacaaaaucuuugaaaaaaugacuuguacuuacuuagcguuuuguuuugacuaacaccccuggugguuguugaaccacaaguucauaguguuaaaagccugugguaaauuacccaguaagcuaagugauuaaaguuguuuggaacauuuugcucauguacaucuuauuuuuauguguauacauauuuauagaucugugcucauaggacuauagcacuauauugcaaagguccuaaccuuuauucacacaacuuccaguguguacaaugugacuugcagagcuguacuguggagcauauccuuuccugugucuuuuguuuaccucugaguaaugaagucaaaucuuacuugauuuuccuuggcuggucuauuuuauuuuauuaaguucugggauacaugugcgggacuagcuagucuuaaauucagucuuuaggaaacguuuucugggcugggcacaguggcucaugccuguaaucuaagcacuuugggaggccgaggcaggcggaucacuugaggucaggaguucgaaaucaggcuggccgacaugacgagacccugucucuacaaaaaauauaaaaauuaaccuggcaugguaguguucgccuguagucccagcuacucaggaggcugaggugggaggauuccuuaagcccaggaauucgagaccagccugggcaacacggcaaaaccccaugucuacaaaaaauauaaaaauuagcugggcaugguuguauguaccuguagucccagcuacucgggaggcugaggccggaggauuauuugagcccaggagguggaggcugcagugagcugugauugugccacuauacgccagccuggguaauggagccagagccugucucaaaaaagaaaaagaagaaaagguuuucugaaguuuauguuaaguguuuguacaugugggaaaacagggaagaacagaucaucugggguuuuggacuuuugaagaugggauguuugaaagcucuuuugguuauguuauucgcuauuuuuuaaacuuuagauuuagccugaagccuaaaacuuuuagccaaggaaacaauguuuuaguaaauggugcuguaauaaacaauaguugguaaguaguuuacauguuaauuuuauaaugauacauuggaaauaucuggcagaauuagaaucaggcugugugugugugugucuguguguguguguguguguguguguguaaucaggcuggucucgaacuccugaccucaagugauccacccaccucagccucccaaagugcugggauuacaggcaugagccacugcaccuggccaggccauauauuuuugaaacagacacuuugauggacuguuuuuacuuuuauggggauaaauucauuugaacuuuguuuaauacagugauugccugcucucucucccacacccuuagggaagaaugguguaguuggcaaagaauggcuuuggaggaaaaucucuuuaugccauuucuaaaauggaaauagugcauuucuuuucuugauuaguaaaagggaaauuaaagauuaugagcaucucagaagaacacugaacaccaacucuuuauuuuugccuucccucauuucucugagcgacagccugagaguuuuauagucauaugaggacucugaaaaauguuagagaccuggcuaaguuguagguaacuagugcauugagaagacugaaaggcuccugaaugcagacaaagcauuacuaauugcauucagggucaggcugucuuuagccggaccaugaaagauacagcagccugucugcugagcggagacucuugucuuuaagaaagacugcuaccugauaugcuagaccguuucagguugcccuaguuuacaugaauuuagucauuaucgccaagacugcuaaaccucagugugauacuucuaaauggacuugaagacaagguauuugaccuugcaauggggcauaggcaacguucauacaguuuuuaaaacacgaaacagaauacuuugcuauuugaaguuuccguuaaaagauugaaugauuuuuaagaucgcaaaguaaacagcagacauaccuuuagaaauuuuuuuaugacuugaacccaggaggcggaaguugcagugauccgagauggcacuacugcacuccagccugggcgacagagcaagaccuugucucaaaaauaauaauaauaauaauuuaagcuuuaauaguucuaucuuuuagauuuaugaaugcuugccccuuaaaggguaagguguuaauagcaguacuaauauacgguaguuuagaccuauuccacaggcauagaccaaccagugcaauuaauucuucaaccucacaaguccuaauguucuagguagaaguguggcugaaauuaaaacugguuauuagacuuuguaauacaaaaguagaaaaaagugauauuagcuaggugguccaauauauuuuugucuaaguaggaaucugaauauuguagaauuguacauuucggugcugcuucuagcuauuccuguucuuuuuuuuuuuucaaauugagaugaguuuuuuuuuuuuccaucaaagcuuaagauaacauaggaauuuuauauggaaguacuguucccacagaacuaacuuuacaaauguaaagcuugggcagagguugaggaaaaugguaaagugauagauuucguaaaaacuguagaaauuuucauugacuuuacuuugaaaauguauaguuguacaugcgaaacgcuucuaguauugcuucuagauguauuauucugacaaaguucccuaagucuuaaauaaguucuuuuuuuuucuaaacagacuuaugaaaauaugcaucaguuuaauacugucuuggaauucaugagauggaagcauaggucaaagcuguuuggagaaaaucagaaguacaguuuuaucuagccacaucuuggagguaaggaaaagaacauaauuuagaauaauaugaaauuucucauuuuuuaauaguugaaaauaauccuucuacacugcaacuuuauuugagccuucuucaguuucuuuguaacaccacaacuuuauaguagcuucuuuaguuuccuuaaucaucuuccugacgaguucauaaguaauucuaauauauauuccucauaaauguugaaccucuucaggagugaaagguauuuauuucuuacuaaucacuuucauaaaucuccuuuuagaagauaagcauuaaaugguuuauauguuuauuucuucccccuaaguuugcaaagcagaguucagcaugcaagauuaggccaggugugccuguaaucccagcacuuugggaggcugaggcaggugggucacaugaggccaggaguucgagaccagccuggccaacauggcgaaaucucgucucuacuaaaaaugcagaaauuagcugagcaugauggccuaagccugugaucccagccaccugggaggcugaggcaugagaauugcuugaacccagaaugcagagguuguagugagcugagaucaugccgcuguacuccauucugggcaacagagugagacucugucucaaaaaaaaaaaaaaaaaaaaagauuauauugaaaaaugaauguuuauguuauucugaaauuuuuacgcuuuuuagaauucagaauuuuuuuuuuuuuuaagacaggaucuugcuuugucacccaggcuggacugcagugagcauaguuucaacucccugggcucaagcgauccuucugccucagucucccacauagcugggacuacaggcacacaucaccaugcccagcuaauuuauuuuuuguagaaacagggucucauuaucccucuguguugcucaggcuggucuugaaccccuggacucaagugauccucccaccucaaccucccaaagugcugggauuacaggcaugagcuaccagacccagcccaggauaagauuuuuuaacauguuagaauaauagaucuuuggaaauagaauuuaaagagguaggagcugccaucaugccagaaauaggaggaaagaagccauccuaagacaguauguacaggaaaaucaggcuuacuguuuuaaaauccauuuagagacuaaugaucagguaaaagguuugaauuauguggggaaucuacauuuuaagaaauagauagaauguaugguuuuaugaaguggucuacgcuuacacuucuggaaguggcaggcuuugcuugcugcuacuguuaauacuugcagcauucacucgcccuucuccugccccugccaaaccgcuggauuagaucuucuaaaaaauaacguaacucucgaauucuuuuguuagguuucauauuguuugauugguagaguugugaucguuuuuuucuuucucaguucuuuugguuucuaugauugugugcucuucugauucuacuuauuuaauuacuccuugaccuuuuuuccuuccccuccuacucuuaaauaauaaugaccuuccccaagguuuuaucuuagaaauuauccuguuuuuuucuuaugucuuuccuagucucaugauuuccgcaauuaucucuaaaaugaucucucucaacuuccuaucucaguuguggcauuuucucuaagcuucaggcccauauuuucaucuguuuacagauggcucagcuuagugccucagacuucccauuaucuagcacaucauucaucaugagcucugcacccgcuauuucuccuucuguuaauggaccucuuugucacccaggcucagagucucagugcuguuucggauuccucaucauuugcuuccuacccuuaggcacaagugaaguccugucaguuuuaccucucuaauguaucacaaauguuugaauccucucuuuccgaaucccccuucaccauccaaguuuaggucuuuauguuacaucucacugaaaauauugcagggaucucccagcuugugcugcuucucgcuccuacuucauuuuacauguugcugccagcuuaaauuaucuuaagagauaauuuugcuuguauugucggugacacuuugccugucugccagaguaaggacagauuccucuaauuuuaaagauaguguagcuuugccuucaucuguccauuucuuucacccuuuaaacauuuauuaaacaccuacuguaugccaggcacuguguuaggucagaaugcaaaacauuaaauaaaaacagguuccuagcuauacucaaaaaauagucuuucuaggguuggaugagcaugaaaacaauuauugaagugcaaucugagaagugcuauauuauaauugaaaagauauauuugauuauuccacacuguguacauagaugauaacuauaacaucacugauaugcccauaauuacauacagcuauaauuuucaaaagaauuugaaaauacaggugaccaugucagaaaacaaagguguauuggcaucaccuggaaagacuacaccaauguuaugagaggagagaauugucaggcaggcuucacagaagagauaauauuugagcagagucuugauggaugaauagaagauugcugaauagaaauuggaaaguguaauacuguaaaauacauauguguuuuugaugccauuuccuggcauucaacucuuaaaauccuugaaaccucugaagugaugucuuuuuguaugcuaaugaguuaacugguagaugacagcccccuagguagcuuuaggaugggggcuggucagcagaaagacuaaggcaggauuagagucagaacuuucaguucccgcccccaccaacccccaacauuuagggaggggagaagggcgaagguuaaguugaucaccagugacccgugguuuaauuaguugugccuacagaaugaacguuccauaaaaauccaaaagaacuggguucagagagcuucuggauagcugaacaugugcaggcucuggugcccuguacaucucuuuaucuguccuuuguaacauccccuauaauaaaccuguaaacauaaauguuuccuugaauucugucagccgcucuaagcaaacuaauagaaccugaaaaagggguuguggguaccuggauuuauggcugguuggucagaagcacagguaaaauaaccugggcuugccauuggcauuggaagugggggccgucuugaggauggaucccucaaccugugggaucugaugcugucuccagguggguagugucggaauuuaauuggagguuccagcuggugucugaugcagaauugucugcuugcuuguugauggggagaaacccucacacauuugguaagaaaagucuucccuguugauuguuuuggugagagggcagaggaaaaauaguuugaguguuuuccauacucacagaaggcaagggaauuaauuucaugcagagcccagagcgggguggaggcagagcuugaaaguguauagaauguacagaagauagaauaauuuuuguauggcuugaauuuagaauaggagagagaguuugagggacaaggcuggaaaggaccuuaugaagaauuuugaaugccauggcaaggagucuagacuuuauuuugugaaaaaugggcagucauugaaaaauuuuaacauuuaaagauauuuuggaucguaauuuuuuguuaaaauuaauaugaugguuguguuagucaguuuucaugcugcugacaaagacauacccaagacugggcaauuuguaaaggaaagagguuuaauggacucauaguuccauguggcuagagaggccuuacaaucauggcagaaggugaaaggcacaucuuagguggcagcaggcagagagaaugagagccaagugaaaggggaaaccucuuacaaaaucaucagaucuugugagacguauucacuaccaagagaacaguauaggggaaacugcccccaugauucaauuauuucccacugggucccucccacaacaugggggaauuaugggagcuacaauucaagaggagauuuggguggggacacagccaaaccauaucguuggugauaugaaugguaguuuggaaaaaggaaaaacuaaaacuagagagacaaguuaggcuauucuuaacuguuucaagcaagaaauaaugaagcugucaacuuaagauggaggucaacuuacccguuuaagcauugguuguuuagaaaauguuuaauuuucuucuauuccccuauguacuauacucuucagcuggugauuugaaaucguccuuccuuuucucuacucucuucucuuggcauauuuuuggcccuuucucucuuguggagugccugugaacuuuaaaaaccccaucucaaaugccaauucaucccuaaaguucuuucuaaucuguauugcuuugacucuaaauauaugucuuuuccuagucuaaagcccccaaagcacuuauuuuuauucuacaggauauuacuuuuuuggucccuauuaaacuauguggcagcaagucacaaaggaggaaucagaaaguaaccugcuccccacccuugguguguaguccaguuagcaagguauguauauaaguaauauaaguaaugauaaccaacauugccaugcaaaagugaggaaugccacaggaguaaauuguugcuucuagucagaguccuguaacugagaagcacagguagaacauaggagguuaugugagcugagcuuugaaagaugaguaaaauuuagauggguaaaggauauuucuggaaaagugcauggauagaaaaugaauguuuuuguaggaauguggugaaggucuuagaaagggcaggaaguaugaugugaagaaagcucuuuuagugaaauuacucuagcagugacauauaaacuauacaucauuagagaaaugaagugaggagguagggagccgagugaggagauuguggcacuaguuaggcauaagcugaucagaauucaaucaggguggugauuguggaaauagaaaagaaagacucaaugauaaagguauugcggcagaagaagggacaccgaugugugacuagauguuggaaagagaugaugccgccugaauuuugagccuggaugguggggauaauguuggccucauuaguagccaagguaaguuggauccuacuuuucuaaauguagagaaacauuaaaauuuauguuuuacuguacuguuggucucuuaauuuguuuaugugcaacaaguuuuuuuggcauuauuuuuccagccuuaacauauucaaagggagauuuuaugaaaaaagcaaaguaugaccucuuuuacaaaagcaguuuuuaaggaaauaaacuguauucuguucauaguuaccucuuuugcuaucauguuaaaugcuauguaagauuuaguaaaacuuaagaauguuuaaaguauuucuacagguauaauucagacaccauuaccaaaggaugguaucuuguuuuaauagaauuaccgcuuaaggaauggggaccugugaaaaauucauucaguagaauucgaugguuccauauuaacagauaggcauuauuaugguacuguccauuagagaaauauuguacaguaaggcaguaaguuaauuauauaaaacuggcuuuuaaaaugcauuuauuaaaauucuuaucaacuguuaacugaugacugauuuagaacuuugcaauauuuagaaacagucuaauacucucuguugaaaauaaucacuaauuguuuuauaauuauaauuauacauguguaaaacuggaagacauuacauuauugaggaaggaaggcauuuguguuuuguuuguuuuuuaagucaggcuuuguguugaacuauuauuuuuuauuuauuuauuuauuuagauggaguuucacucuuguugcccaggcuggagugcaauggcacaaucuuggcucacugcaacuucugucuccuggguucaagugguucuccugccucagccucccgagaggcugggauuacaggcacccgccaccacgcucagcuaauuuuguauuuuuaguagagaugagguuucgccauguuggccaggcuggucuugaacaccugaccucaggugaucugcccaccucagccucccaaagugagccacugugcccagugcagcauacucuguuuacaagcacaagcaguguagccagaggacuucaguuugaaucuugacuuuaccacuuaguuuguguucccuugaaagaagagccugagaaaaagacuuacuggcugauagguuauuugggagaugaaccaaaaagcagaagugagagaaugggaaaagugagacagagaagggagugaaguuucauuaagugggugauccaguucccccugcgggcagcugggcuucagcccugugggugucuucugaauguaccucacuguugucccaccaaaggacagggagccugagacaugcaugcaccaacuuucaccuguuguuaauugaagguugcuccgugagcuuuaacuccggcaggucugugcuugugccuccaugcuguugagcagucucccuuagguuugcaaagucuccgaggaacaaaacagagcagugccuccacucccacuugagucaggugcugugcaugccacauagaccugcccaccagagccacagugcggagaggggugagcugcagagcaccacgaaggucugcuguggucugccccuuuuaccagugagacucccucaugccccauuagaucuacucugucacugacccugcagauugguggcugauuaugaucacuaaaagaaauaucuaacaggugcaguggcucacgccuguaaucccagcacuuugggaggcugaggcgaguggaucaugaggucaggagaucgagaccauccuggcuaacauggugaaaccccgucucuacuaaaaauacaaaaaauuagccgggugugauggcgggcgccuguagucccagcuacucgggaggcugaggcaggagaauggcguggacucgggagguggagcuugcagugagccaagaucgugccacugcacuccagccugggugacagagcgagacuccgucucaaaaaaaaaaaaauuauauauauauagauauauguauauaucucugaaacaagaggguuaaaaucccuaccacugcagcugguccugagcucuuauuuccauccuugacauucauaugagaaugcucuaagagcccucaguugugcuggcaguaggguguucucuggguagggaaggcaagcccgcaucuggaguguugguucugcacccuccuuguuagcuggcauuuggcaguggcaguaguuaggucacccuucauaagaaggagcccaugcuguugggccuauguagagccuuccucucugucacuccacaggcuccauugacgggccugguacuccagccuugggaagaagcuggcugacagcacugacaagccauccugucuguccuugggguguaguugaaugccucuucugugggaggugccuuguguugggcauucacauaagauaaagauuggcacuuuguguucccugccuuagggccgucagcgugccucuucuccaggcuucuggucucuuauuuccuuuuuggacccuuuuaauacaaaaauuagccgggcauggugguacaugccuguaauccuagcuacucgggaggcugaggcaggagaauggcaugaacccuggagguggagguugcagugagccaagauugcgccacugcacuucagccugggcgacgaagcaagacucugucccccgccgcccacacacacacaaaaaaaauuaaccacacacccacuugcuucuguagagaaaccuagaacuccuggucucagaaaugucauccaggucucgcuuucaggcuuuuugauuauucugcaacuccagaaaaagaggcuguuuagucccacucucuuccauucagacugucuccucuuaaguuuuaaagauacuauuauuuuuucuuaauuuaagcuuagcggauuuacuucugguuuugaucccucuccaguuugggugcuuuaauuuuauuuauuuauuuauuuagagguggagucucgcucugcucucugcuaauuuuuguauuuuuaguagagaugggguuucacaauguuggccaggcuggucuugaauuccugaccucaagugaucuacccaccuuguccucccaaagugcugggauuacagacgugagccccugcgccuggcccauuugggguacuuuuagaugcagacggugguuugggaacuugcagcuccauaugguauaguggggagagcaugccacaagguuuucagguaauaugagguuuucuccucauauucucuuacuacacuucaauuccuaacuuuaucuuccagccuaauaauuucucucuugcacuacugucuuaugguuucaacugugaaagguaauuuccagucucggugucacagauacuccaguuuaaccucugauuauaucuuauguauucuuucuuccuuccuuuuguuucucccuucccugcucugucuuuuauagggcagggguuagggaacgucucauugccccuuuuguuuuucuuuuuccucauugccucuuuuuaaaaugaucuuuuuuuuauuuuuaaaagauuauauauuggccaggcacgguggcucaugccuguaaugccaacacucugggaggccaaggugggaggauugcuugaggccaggaguucgagaccccaucucuauuuaaaaauacacacacacguguguauguguguguauaaagauuauguaagcagccuauuaauaaguuccuauauaaaauuuuaaacacuaugcaccaaagccuuuuagucccucuuccccacccuucaccccauugcccuccucaccacccuccuugcccuccaucccacugccaucuuggggaccucuguuucuuagguuauuggucuguuuguguauuccauucccuguugaguuaauuuuuguauuaauaucuuuauagaaaaugauacuuuuuuuuuuuuuugagauagagucuccaucugucgcccaaguuggaguacaguggugccaucuuggcucacugcacccuucgccccccggguucaagcaauucuccugccucagccucccaaguagcugggacuacaggcgccugccaccacaccuggcuaaaguuuuguaguuuuaguagagauggggcuucaucauguuggucaggcuggucuugaacucccgaccucaaggccgaacugccuuggccucccaaagugcugggauuacaggcgugagccaccacgccugguccauacaguuauucuugauuuucagauuuauucuuauaaaauuaugccuaaugagaauaucccucucauaaaguuagugugaagauuaaggaauuuaacauaugaaguauguagaacagugccuggccuauagagcucuaaguguuaacuauuauuuaauauuauuaugcuugaauauuuauaauuauuuuugguaggccuccuuguacuucguauuauuuauuuguucuuuauuuuugugcuuagacuuccuagggauauugaacuuucuagauaauuucaugggucuuuucaaagagccagcauuuugguuuuauaaauuaacuccacuuuuuuguuauauauuuaauaauuuuugcuuuuaacauacuaccuuuucuuccugccuuugguacccauucuuccaucucgguuacacauaauauucuucuauuuuuaaacauuuuucuguuguuucugaggauuuaggagcaguaggaacacauuuguuuauucucccagccuuaguuagagcugcuuguauauuuucaaaagcuucuugcaccucugucuccugauggucuguaauuuuuccagcaacccaggauuuaaaucugggaaccaccuaugacaacugcaucucugcuuucuaucagaucuagaaguugcuaaauuuuaucagcccccccucuauaauaguuuucuuccacuucccuauucucauugccucuugguugggaugguuacuucuugugugaacuacuguaauuacccuuuggcuuaucuaccucacccugucccuuucaucccauguaaugcuucaagagugauuuuucuaaaccauggugcacucacuucuuugcucugaaaccuccagugauuucuccuugucugcugaguaaaguucaggcuacuuuacacuagcauuugagaaucuuaugaauuaauuccugccuacacuuaaucauucuuuauuccuuuguucuuuaggaaaaaucguaauugguaagauaaaccaaauauaaaacuauauaguaaugcuguuuuucagucuuacugaucucacucuauuccuuaucuuuaccaugcuuuucugacuuugugcuuuugccucuggauuucccagucuggaaugccucucucacauccuaguauguugaaaucuguccauuauucaagugugagcuuagaugccaacacuuugaugaaggcuuaucugaucccauugccuagaauuaaucuucucuucccaugucuuuggauuugaacugcagcuucugugcucuguuacuagucauuccauuuucgauagucuaccaguaacuucugugccuuagauccacauuuacacuggcuugucaggauuggucagugaaucaaauagguaguaaguauaagcuucuagaacuacacucuccgauaugguugucauuagccacuuguauuuugacuacugaguagccacauaugguuaguggcuacuuuauugaguaacauagagacuuucaugauugcagaaaguuauuuugagcaguaucuagaacaaugccuggcaaauaauagacaccagggaauguuguuccuagguaucacauccucauaguagacacucaguaaauauuaguuuaacuuuccuuuccucaucugaauuuuauuagcguuuaccugugccauuuaaaaaguaacaguuuauggcagcuaacacaguguaugaacaauaaauauauuuugggugaguaaguaaauacuacgaagcauccagaaagcaucuugcucucuuuugggguggggagaguaggggaguggaaguuaaaaaaaauucacuacucaggccgggugcaguggcucaugccuguaaucccagcacuuuggaaggccgagguggguggaucacuugaggucaggaguuugagaccagccuggccaauauggugaaaccccaucucuacuaaaaauacaaaaauuagccaggcaugguggugcaugccaguaauuccagcuccuugggaggcugaggcaggagaauggcuugaaccugggaagcggagguugcagugagcugagauagcgccaccgcacuccagccugggugacagagcggacuccauuucaaaaaaaaaaaaacaguucauugcucaauaagugaauauuuccaggaugcuuaaauuaaacaggguagacuaagcagcuaaauaaagguggucuuaucuacugcuuuucaaauuuaguguacgcgcaugucaccugggggucuuguuagaagauucuaauucagcacggucugggauucugcauuucuagccagcuugcaagcuagccagcucugcccagugaggguguaauucacuagauuggcuacuuaaacccauuuuaacauuuccuagucuuuagaacuaguccuuuaauuuagcucaaaguuuuguuguuguuguuguuguuuugagacagggucuugcucuguugcccaggcuggagugcaguggcaugaucaugacucaccacagccuugaacuccugggcucaagugauccuccugccucagccuccuaaagugcugagauggauuacaggcaugagccaccacaccuggccuaaaguucuccuuuuugaggugauaauuuuuaaagacagcccuuauauguucaggaaauauaagccuguuuuuacauaaaguaggugcauuguucaguaccaauaugagaaagaauuaugaauacagcuuuauauuauuagauuucuuaugucauaauauaaaaaaccgguaaacuuagcgcugaacuauucaugauaguugaaaguuuuaagcuaauucaaaauaugaaauaaaccagaaauauuuuggaaagaagagguuuuaaguauauucagguccuccauuuuaugaugugagucuaaauuucuguucucugaugucuagaaaucacaaaaggauggugauuuugggaacgaaguucuugagcuagcacugucaguaguaacuggccguuacuguaagaucuagagauauauuuuuagaugccauuauacuuacaaagaacuguuagagugcauuuuaugguuuuaugguugguuuaauuccccaaauauauugcccuuagcaaguuauuacuauuuuuuauuucuuaaauuuauuuauugaacauuuuuauuccuuuguuuagaaaugugcuagacaguggcaauuacauugcugcaagauaaguaaaaaaaucagcugacuaagcuuuauaagaggaggaaucaugucucuuuuauuuaccguuggauagucacuacauggcacauaaccaagucaucauuaagucauuuuugagugaacauugcucaagaucugcaaagcagcugugaugugugcgggguguacuggaaguugaacgggacuccucaagcagccuaaugaguugggauugaggauugcauacacaagggaacucgcagaucaaguccugaagagaacauuguaguuacucuggcaaagaacaacgaagacacaaaagcugugcagaguaauggaagccuggaaggagugccugugaagggagagcggcugcacugacuuugguagaguuggagcaucguaaggguauggaggagaggggaggagaguaguagaggucucagcaguugucagaugacaaaaagucuugcguuacuaauuuuaucguaugaaaugaggauauuuuuuagguuuuuaagcagagagaauggcaaggucauuugguuuuagaaguuaguccgagcuaggcauggugacagaugccuguacuggacaagcugaggcaggaggauggcuugagcccaggagcuggaagcugcagugagcagugaucacaucacugcaguccagccugggcaacagagcaagaccuugccuuuaaaaaagaaaagucugaaauaccccucacaacuguuaaaaaaaaaaaaaaguucuuucaagcacacguggaguguuuuaugaaagugaccauuuacuaggcuauacagcaaguucuuauacauuucaaauaaaaucaaccauguuuucuggcgagaaagcauguaggaagugaauaacaaacuguacacauugggaaauuuaaaaacacacuucuguaaaucccacagauuaaauauaaaauaaucaauuuagugaacaccuagaacaaaacaauagagaaaauaacagccugagcaaaauagugagacccugcgucuacaaaaaaaaauaaaaauuagcccggcacaguggugucccccuguagccccuacucagaaagcugagaugggaggauuacuugagccugcaaaguugagucugcagugagccaugauaacaccauuacacucuagccuggacuacagagcgcaagaccuuauuucaaagaaaaagaaacuuaggacauauuaaaacgugugugaaacccugaagccuuaaauauucauauuugaaaagaagauuuuaauacuaauaagcuaaucuaaguuagggaaagagcauggcaguaaauucaagugaaguaaaauagagaauacagauaaaagcuaacaauucuagaguucuuacucuauuccaagcaccguuccauguucuuuacaaagguuaucucauuuaaucuucacaaagccauaugaggaggguauuguuauuaugugcacuuuacacaagaggaaacuuaggcacagagagaaacuuauccaagccucuagcuaauaaaugugauagaauuggggcuugaaaugaugaauuuuuuaaaaaaagauacauugaagaggauuaacagagcugaaaguuguuuuuuaugaaaggcuaauaaacuauuugaaagauugaucaagaaaaaauauaaaguacaaauaauacugaggauauaaaaggaagauacagaagaaagucuuaaaaauaaaauaucuugaaucacuuuauaccaauaaauuuuacaauuuaaacgucaauuuucuagaaaauuauaacaaugaaaauugacacagaguaaauagaaaaccuggauauuucuguaacuguuagagaaauuggauuuguaauuaaaagaaccacccacuuucauauauucagagauaagccuuuggcccagaugaucuuuuuuucuaagaaaaaaaaaaacaggccucuucagagacuucauuuauuauaugaagaauuagugaaaacuuugucccaccauuuuaggcuauuuuuacauuagaaaaaauacugcacauuuaugaaaauuuacuaggggcaaauuucaacuuaucuguaaaauaguaaugccaacuguggagauggcacuguaaaccaaaaggcacaaugacuaaagaaacuacugaaaauuuaacaauuaucucuucauuauccuuccuuauuggggaaccugccccgauagucauguagguucuuuucuauuuuccguaaguguuggcugguuagagaaauaaagggacagaguacaaaagagagaaauuuuaaagcugggcguccgggggagacaucacaugucgguagauuccgugaugccccacaagccgugaaaccagcaauuuuuuauuagugauuuucaaaaggggagggagugugcaaauaggugugggucacagagaucacgugcuucacaagguaauagaauaucacaaggcaaauggaggcagggcgagaucacaggaccacaggacggggcgaaauuaaaauugcuaaugaaguuucgggcaccauugucauugauaacaucuuaucaggagacaggguuugagagcaaccagucugaccaaaauuuauuaggcgggaauuuccuuguccuaauaagccugggagcgcuaugggagacuagggcuuauuucaucccuacagucucgaccauagaagacggccacacccaaggggaccauuucagaggcccacccucaggggcacauucucuuucccagggauguuccuugcugagaaaaagaauucagcaauauuucuccuauuugcuuuugaaagaagagcaauauggcucuguuccgcccggcucaccggcggucagaguuuaagguucucucucuuauucccugaacauugcuguuacccuguucuuuuuucaaggugcccagauuucauauuguucaaacacacgugcucuacaauuugugcaguuaacgcaauuauuacaggguccugaggugacauacauccuccucagcugacaggauuaagagauuaaaguaaagacaagcauaggaaaucacaaggguauugauugaggaagugauaaguguccaugaaaucuucacaauuuguguuuagagacugcaguaaagacaggcauaagaaauuacaaaaguauuaauuuggggaacuaauaaauguccaugaaaucuucacaauccauguucuucugccauggcuuuagccagucccuccguuuggggucccugacuucccgcaacacuuccugcuccaagauuugcuaugaugaguuuuccaaauguuaacgaccuggaaaagcucauugucuuuaagacguaucccuucugagucuugugauuuggugguuucuucauccaaaacguaucauccucuauaaaacucccugauccucagauuuaacuuuucaguuucuuuuuccaaguucucaucagugguuuaauggcuguaucugagcaccuaaaagguaaagacucuuccaagcuguugagacucccuccaggcaggggaaugacuaucugggucugagauuaugucauuaaguucuuuuuuuuucuuuuucuuuuuuuuuuuuuuucuuuuugagacagagucucccucuguugcccaggcugggaugcaguggugcaaccuccacucccugcaaccucagcugcuuggguucaagcaguucuccucagccucccaaguagcugggauuacaggcaccugccuccacgcccagcuaauuauuguauuuuuaguagagacaggguuucacaucaggucucgaacuccugacaucaggugaucaaccugcugggauuacaggcgugagccaccacacccugcgucgcuaaguuuuuuaaccagagaggcuucagguuucagacacacagaagcauaauucuggccauacaaaaaccucaguuucuucugucuuccacccaaucaaagucuccuucaaaacuuuaaguaaguuucuauuugccacuucaggacacaccugcacugaacuagacacugacuuagaaacuugguuugauuuggcaaauuuucuguuaaaaugcuccauacuuuucuuaugccuauuagaguuauuucugaccuacuguauuuacuuucagaauuuucugaagcuauaaucuuucaggaaauaguacuauuuuuugaaauaguauuucuauuuuuugaaaauaguauuucuauuuuuugaaauaguacuuuucaaaaaaguacuauuugaagaacucuugaguauuuacuuucuguaaaggaaguucacauguggcagcuuucuccugaguaucuaauuugcaauugccuaacugcucagugacauccacuacugucuguucuuuguguuuggcauuagcuuugagaccagcuuucuuuuucauuaugcuuuuuuggugcagcugucgucuaauacuuguugaauuuggucuguuuccugguagaauggaggaaacaaagucuugcucauuaucacugcugcugucauuaugagugcuggaagaacaauugcuagaagauucauauugcuuuucaaacuggcuaggauuguugauaucugauguuuuaauggcuuuacugcauaacuauuucuuuuccagaauggccacuuugcccuuccuuuagcaguugaaaaucuggaugccucucaccguacuggaguuuugggaauuugugcuucaaaaaacucagaugcuucauaacaaaaauugcugcaaaaagacuuucuuucaguaauaucauagacuuuauugguuuugaaauuuuauauuuaauucccagcuucuugugacauaaaggauaaccacagaguuugacaauagaauguucauucacuacaucguuguagugagcagguguaaugaacuuccccuuuuagaagcaucuucuuguuucaaaguacuugucuguuuaguaccuguggcauuucgagaauggugggagcccuggcccucugcagcccagggcagucagccaugggagagaguagucugcgggucuggaccagcuccagagucucgccccgaggcaccaucucccuaccuggcccacguuaucuuaagggugaauucuuuuaaacuguccaugucguagguauguccagauuuacacaugccauuccagagaauagcaaauuaaggaaaguuccucaguuuauugugacuaguauaacuuugguaccaaaaccaagcauggcuaauaugaaauaaauuauagaccagucuugcuuguguaaaaucuaacaagauaggagcaaaagaaguccaguauuauguuuaaauauuuuauauguauauaucucaugucuacaaugcugacuguaauacaguucugacagaguuagcaugaaacuccacagguuuaagggugcaguucccaacgagacugcccuugcugcgaguacaaguuaaaaguuuggugguccccagaccaccuguuauuccgauuaacuggcugcaaaucuggggguucccaugaauccccucaaguuugauaauuuauaaauuaacugacugaacuugggaaagugguauacuuaaguuacacuuuaauuaugaagaauacagaucaggaccagccaaaugagauacaggguacugggaggguuccuaacauggagcuucugugcucucuucuccugggaucaggguaugucacccucuugacacaucaguaugcucaccaaugaggaagccuaccugagcuaugguguguguagauuuuauauguagguguaauggaauaauuggccaugugauugaacucaaacuuucaguguucucuccuuucuuccuuagaggcuuggcuagcucaaaccccauccuucuacacaugguggccuuucuggugagcagaccccauucugagucaucuuguuagcauaaucucccccauucugagucaauuguuagcauaaucucaggaaugauccaugaggcucgugaguaacaaaggcauuccuacuaccaaggaaauuccaugaauuagagguucucucccaagaacuagggucaaagacugaauacauuauuuauuauacaauaaugacaaauugaaauuaucccaggaaugcaagauaaguguguuaauuaucauugcugcauaacaguuuaucccaaaacuuaaugacaugaaacccuaauuuacaagaauucaggaguagccuagcuggaugugguucuaaucuuuauguuucacaagguugcagucaggaagucagcaggggcuacagucaucugaaagccugacucggggagaauacacuuccauguggcauacucacauggugguuggcaggaggccucaguucuucacccuaugggccuucccauaggcucgaguauccucacacugugacagcuggcuuucuccagaucuagugauccaaaaaaaaaaaaaaaacaaggagaaagcugcagugccuuuuaagaccuagucauuacuuuauucguuucuuuuuuuuuuuaaauuaaauugagauggggucuugcuauguugaccaggcuggucucaaacuccuggucucaagcaguccuccugccuguuccucccaaagugcuguuauuacaggcagaagccuguaguuuuuccuguauccuguuuguuagaagaagucacucaguuuaaccuauacucaaaggaauuaguuuccaccucuuaaaaagaagaguaugaaagaguuuguggacauauuuaaaaaccaccacagaugguuuauucaguaaaguucuuaauaugaauuaguauuaauuuauuaauucauuugcacauuuugaaggagaaaaacucugugcucauaucacuagaugaagcaaaagcacuugaugaaauuuaacuccaugaugaaaccucucagcaaacuaggaagggaacuuccuuaaugugauaaagacuuucauuaaauuuauaauuaauuuaggaacaguugacauaccuuauauugaagcuuucuguacguaauaugauucaucuauuuguuaaacuuauuauuuuguucuucaguauuuuaaaauuguguuuauaucaguguuuuacauuuggaauugcaaaaugauauagugaaagaugaagacuggaaguccuagcuagagcaauuaggcaagagaaggaaauaaagggcaucuaaauuggaaaggaggaagucgaauugccacgaucauauauauauguggaaaacccuaaaaacuucaccauaaaacuuuuagaacugauaaaugaauuuaguaagguugcagaguacaaaaucaauauacaaaaauuaguaguguuucuauacaccaauaaugaacuagcagaaaaagaagagaguaauccauuuacaaaagcuaccaaaaaaugaaauacauuugaccaaggaggugaaagaucucuacaaggaaaacuauaaaacacugaugaaggaaauugaagcgggcacaaaauauggaaagacauccauauucaaggauuugaagaauuaauacugugaaaaugaccauacuaccaaaagcaagcuauagauucaaugcaaucccuaucaaaauaccagugacagucuucauagaaauagaaaaaaaauccuaaaauuaauauaggaccauaaaggacugcaaaugccaaagcgguucugagccaaaaggacaaagcuagaggcaucacacuaccagacuucaagauauacugcaaagcuguaguaacugaaacagcaugguacuagcauaaaaccagacaguagaccaauugaacagaauagagaaccuagaaauaaauccacauauuuauagccagcuggcaaaggcgccaagaacaugcuuuggggaaaagacagucuucaauaaauggugcugggaaaacuggauauacauaugcagagugaaacuguaccccugucuuucaccauauacaaaaauaaacucaaaauggauuaaagacuuaaauguaagacaaaggcaccaaagacaaagugaaucaucuauuuucuuuuauuauuauuauuuuuugaaguauagagauggggucucacuacauugcccaggcuggucucaaacuccugggcucaagugauccuccugccuuggccucucaaagugcugggguuauaggugugagccauuagcgcccagcuaaauacuguauuuucagcccauguuugccugcaauaugaagagauugcuauacuuauugaaaagaagagaccggaaguggugguucaugccuguaaucccagcacuuuggaaggcugaggcagguggaucaccugaggucaggaguucgagaccagccuggccaacgccaucucuacuaaaaauauaaaaauuaaccaggcuugcuggcaugcgccuguagucccagcuacucgggaggcugaggcaggagaaucucuugaaccugggaggcggagguugcagugagccaagauugcgccacugcacuccagccugggcgacagagugagacucgucucaaaaaacaaaaagaacuugcauauaaauugacccaugcaguuccaaccuguauuguucaaaaaaaccaaaaccucccuuagaccuagaaucccacuucugcaaauccagccuacaguuuuaucagcccaaacaacaacaaaagcaucucuucaaguuuauuuauugccgcauugcuuauacuaaauuauuggaaaugaucuaaaauguccaucaacaugguugugcacuguggcaugcaccuguaguugggacugcucgggaggccgaagcagugcaaucugauugcaccugugaauagcuccugcacuccagccuggaccagcauggcaagacccuaucucuaagaagaaaauguucaucaacgagaaugagcaaauaugaccauaagauauuuauaggauaaaacacuagauaacaaugaaaaugaauuaagaagaacuacaaguaucuaucauggaaauacuucacaguguuaugugaacaaaauuaaagcauuauauauauaaaaacaguaaaguuuuuauauaucuguagaaaguuuaacaauauguaaggcaaugcuauauguuacuuaacaauccuuucuuugaaauaaaaggcaaguugauguguguuuaaacuagaaaucccaggaaaaaaucagaaagguaccugggcuuaaagaaaaaugcuaaacggggcugggcgccaugacucacaccuguaauuccagcaguuugggaggccgaagcugguggaucacccgagaucaagaguucgagaccauccuagccaacauggcaaaacccugucucuacuaaaaauacaaaaauuggccaagugugguggcaugugccuguagucccagcuacucgggaggcugaggcaggagaauugcuugaaccugggaggcggagguugcagugacccgagauugugccauugcacuacagccugggcaacagaaugagacuccauaucaaaaaaaaaaaaaaagaugcuaaaaggaaagcagggacaaguaaaugucaaauccauuucaugccauagaacuuuuuuuuuuuuuuuuuugaggcggagucucgcucugccgcccaggcuggagugcaguggcaugaucucggcucacugcaagcuccaccucccggguucaugccauucuccugccucagccuccccaguagcugggacuacaggcgcccgccaccacgcccggcuaauguuuuguauuuuuaguagagacaggguuucaccauguuagccaggauggucucaaucuccugaccuugugauccgccauccuuggccucccaaagugcugggauuacaggcgugagccaccgcgccuggccuagaacuucuuacaacacccuaaaccaguacauuucaaccugaaaagauguuguaacgcagaauaaagaaaauaaaguacagauauuucauucccaaggcggggaacucuucuagguucccaaguucuugagcuucacgugcauacagcaggaaucugucaucuugagggaguucuuucuuaaaccuauggguuuguaagauuuuaguuuucuaugcuguccuuuuuuggucaugcuugucagggaagaauuguuaaaaaucuauuuuaacacccucugcccuuauucagggcaguuagagacuuaaauuuuacguacacauacuaccuuugaaccuucaguguguuguuuauguacugaaagauugcaguugaauuuagaucaugcuuugaaguucccuuugucagaccacauuguuuguacccaaagaaagacuucauuuucuuuuugucuguaauuauuuccauacuuauuuaacuugguauaacaugugguacuguaaaagcauaacccaagccauuguuugccuuaagcaacauuuuagacauuuuagauuuggggaugugguguuuacuuauacaagccuuucuuaagcccuuuuaauuuauaucucaaacuugaggauauccaugaaaacagcggaaacuuuuuccucaccggaucuugacacaagucagggauggaagugagcaaaaggaaguggugugguuuuuauaucauuucaguuguguugagauagggaaaugggauaguuuauccacuguacugcucuuuugggaaagucugguuuguauauaaaagugaaaggaauuggcauaauguuuuaauuucuucugcuccauucagucauucccucaauaaauauuuauuuaguaucgacucugugccaggcacuguuccaggugcuaaaaauauaaagugagugaaacagacuaacccuccuggccucauggagcauauauucuagagcagguggcaggcaauaaaauacagaaaaauuauaucaaauuauauagcaugacaaaugcuaaagagaaagaaacagccagaaaggagaggagugcuaggcauggggaugggauuacaguuuuaaauagggugggcaggaagccuguaaauaagaaagggauuuugaguaagugcuuggaaggggcaaggcagcagucccggggaagaccauuacaggcauagggaucugcacgugccaggguccugcagcaggacugugagcggcaggugcaaggaacaccuauuaggcuggaacggagggaggguggaccacuggagacuuuagcuuuuugucugagugaguuggagcaccguuggagggaucugaauggggugugaugugguuuaacaugcuuucucuuaggaucacucuggcugcuguguugcaaauccauagugggcacagguggaagcaggaggccaguuaggaggugccuucagcaauccaggcaaagggguuaguggcuugguccagagcgagcaguggagguaguaggaaguguguggguucuggacagauucugcagguacaaccaguggauuugaugacaggaaauggaaugcaagaaggaaagagggaguugucaagaaugacuugagauuuuaggccugguuacaucaguguagcgauauucuaaaaauaaaaaaaaaaagauuuuagaccugggacuuuuaagauuuuacaccaaguaaagaggcugucaacggaggugggaaagacuuaggaucuagcaaauuugggagggaagaggcaaggaaagauaaauagugacaaauuguauaguugcugauaacauuguuaagucaauauuuauacuauuugagcugccuuuuuuuuuuuuucccccucugagacagucucgcuuugucgcccaggcuggaaugcaguggcacagucucagcucacugcaaccucuaccucccagguucaagcaguucuccuaccucggccucaaguagcugggauuacaggcacccaccaccaggccuggcuaauuucuguauuuuuaguagagaugggguuucacuauguuagccaggcuggucuugaacuccccgccucaagugaucugccugccucagccucccaaagugcugggauuacagacgagagccacugugcgggccuuagcugucuuaaaaauagcacuuauagcagccuguguuuucuuuucagauguuaucaaguaucuuuucugguaagacauuuauuugccuuuauucagaauugcuaauuuuaugcuaaucuaacccagaauacucaagugugccuuucccuuuaauccucauauuagcuauauuagcuagaauauuuuugguuguaacagaaaaauugacucucucugaccuaaaaaauggaauuuauuggcucuuaagaguuccaaaguaauugaggcuucagacaagguugcuugaguggcucaucgaugucucccgggaucuggcuucuuucagucuccuggcucugccuucugguucuccuucugggcccaacauagcugccagcaguuucugggacugccuuauucauauugagucugagagagugacuuugucacugcagggucagucaaaguccugagacuauuagaccagcucgccccugaacuuuuuguggcagggaagauagaauaugcuuaguguaagagccucuacuccugagaucuuaggggaaaucuuuguacccugaauuaaaaaaaauuuuuaaauaguuacauaaguggaaaugauugauuuuuaaaaauugcuuuugcauuguacaagcaccaugguuaacaaaacaauuccuuuuuaaagcagucaggugggaagggaaaaaaaguaaaauuguauucauacauuaguuugaucaagauaauuuuucuucuuagagauuuaauaguguugccacuugaccagcuggaacuacaaaggaaccauuagauaguaaugaaguaugauacccuuuucagcacuccuucucaccuuuuuacuuuacaucuccaguuuugccucgcacaaggucucuucuuccucuguggauccucuaccuacaugugucuaccugcuaauuagacaggcacaugcacacuaguuuucuuuauccccaaaauucaguuugcaaaugggaccgaagagcucccuguuccccucaugacaccgacacgacaaaaaaaaguuauuccacuaauucccuugauggucgguuuaggaguuucugccuccacuauugcucucgguacuggaauaacaggcauuucaaccucugucacgaccuuccguagccugucuaaugacuucucugcuagcaucacagacauaucacaaacuuuaucaguccuccaggcccuaguugacucuucagcugcaguuguccuccaaggacaacuccgaggccuugacuuacucacugcugaaaaaggaggacucuguauauucuuaaaugaagaguguuguuuuuaccuaaaucaaucuggccuaguguaugacaacauaaaaaaacucaaggauagagcccaaaaacuugccaaccaagcaaguaauuaugcugaauccccuugggcacucucuaauuggauguccugggucucccaauucuguccuuuaauacccauuuuucuacuucuuuuauugggaccuuguaguuucucaauucauccaaaaccguauccaggccaucaccagucauucuauacgacaaauguuucuucuaacaaucccacaauaucaccccuuaccacaagaucucccuucagcuuaaucucucccacucuagguucccacgccgccccuaaucccgcuugaagcagcccugagaaacaccgcccauucucucuccauaccaccccccaaaaauuuucgccgccccaacacuucaacacuauuuuguuuuauuuuuccuauuaauauaagaaggcgggaaugucaggccucugagcccaagccgagccaucguauccccugugacuugcacauauacgcccagauggccugaaguaacugaagaaucacaaaagaaugaauaugcccugccccaccuuaacugaugacauuccaccacaaaagaaguguaaauggccgguccaugccuuaacugaugacauuccaccacaaaagaagugaaaauggccaguccuugccuuaacugaugauauuccaccacaaaagaagugaaaauggccaguccuugccuuaagugaugacauuaccuugugaaaguccuuuuccuggcucauccuggcucaaaaagcucccccacugagcaccuugcgacccccacucugcccgccagagaacaacuccucuuugacuguaauuuuccuuuaucuacccaaauccuauaaaacggccccacccucaucucccuucgcugacucucuuuuaggacucagcccgccugcacccaggugauuaaaagcuuuuauugcucacacaaagccuguuuaguggucucuucacacagacgcacaugaaacuaggcaagaaucaguguuucucuacaaauugaguugacaaaaagaaauuaucuuccccugcccccacaaaaaaagaaccaguauuucucaacaaggagaguacuguuagcauuugguucuuuauuuugaaggauugucccugcacauugcauuuucuauccuggucccuggucaaacuguauguccugucauaucccagacauuauuccaaccaaaaagucaccuacauauuuuuagauccucuuaggagggggugguaacccagccacugcugaugccugaggggagugcaaagcuggguuuuugaggagcugggacugagauccugaguaguaggcaccacugggccuaaaaggauuccaugggguugguucugggaguguggaaggaagcagagaguguagauugcugcugccaauugaaugccaguggcauucaggcaacugacaggaacagcgaaccaaauugggaaaaagaaagucccuucuccccucuuccagcuuucucuaguuccccaguuggcagagccucuccaggaaccagcuggugaaggacauauugucagcagcaucccagcuccagcaucagaaagcagaaucuauagauagaagagggagcuuuuuuuuuuuuuuuuuggcugaaaagcgauaguguaaaaagggacacaguacuuucuguuuuuuaaucucauuacuuuccugccagcgccuuaacaugcaguaacaaguggaauuugggcuuugucagcagcaaaccugccacuuacugguuguguuaaguugggcaaguuucuuucuuuuuuuuuuuuuuuuuuuuuuuuuuugagauggagucucgcacugucaccugagcuggagugcaguggugugaucuuggcucacugcaauuucuaccuccuggguucaagugauucuucugccucagccuccugaguagcuggguuugcaggugccugccaccacgccuggcuaauuuuuuguauuuuuaguagagacaggguuuuacuauguuggccaggcuggucucgaacgccugaccucgugagccaccaugcccggccaacucaggcaaguuucuuugcgcuucauuuuuuuuuuuuucagaguuaugaagaugaaaaaagaucuuacaggguucaguaaaaaauaacuuccaguuuccuguuuaacauaugugcucaugguauacccgacaaaacacugcacuuuggauuagaaaaccuggguguuaguuugucauauauacuagcuacauggaauucagcaaguuauuuaucuccuugaaccuaucuuuucucuguaaguaggaaugauuuuacuuacuguaaggaucacagagaugggauaaugcacguaaaacuaauuuguaaguuauaaaaaugacagugacaaugggaugcuaagcagguaccauuaaauaccaccacauaucugaguuucucugauuuaaucugcacaaaauaccuagaucaucuguuuuaggcuagacucugaacucuuuaccaccacauuaaacuguuuuuuucucuauucaauuuaccaguaaagguugagcaucccuaauccaaaaaucugaaaucugaaaugcuguaaaaccugaaguuuuugaguguugacaugacgcucaaaggaaaugcucauuagguguuuuggauuugaguugcugaaccaguaaguauagauagugcaaauauuacaaauuuaaaaauccaaaauccaaaacacuucuggucccaagcauuucuaauaaggaguagucaacuuguacccauuguaugccuauggggugaccagacccucucccuuuccagacaguucugcaauaacugauucacuucgccuguuuuuggucauuucugcguguucuagaggagaaacagaagagugacaccuaggucucuuaaauagacagcugacagacauuacgaaucucuucgaaguacagauaugccaaagauugcuguguaguacaaucuaguuguaauugugagacuuuuguuguuguuguugaauacaguuaaacaaaaaagcuuuggagaaacuagguuagggaauuuguaguacaagguugaaugauguuuugaaaacagauuaucuauuugaaaaauguuucagaaaccuggaagcauuucuucugcaucuaauguugagguccuggugaaggguauaaaacacacagcaucaacuauauauaaugcuauacuagauugucuugauucugugguccuggaagaguuuauacuuguguuggggaaacuaucuuggcauagaaggaaagugaagguuuugaguggggcagggacaguugagcagaaauacaaagguuaaaugugggcuuguuuugauuguuaauuaauaauugagcaugggggaaagguagaguuggaaaguaauuucagggguggcgaugaaauugguaacuucaaagugguggagacaugacaguggaaguuuuauacaguggaacuuccccaucccuguuuuaggucuucacuuaguugcaugguuggcucucuuugcuccuggcccacgggcauuauuguaaaacuuucuaaaacacccuguuaugaaugucuuacccauagcaagaucugacagcguggacaccaaggcaggcauuucgguaagauuucuguguauuaccucagauacacucagacaacucuuuaagcaaguuauuuucuucaggguuuauguuuagauuugcgggauauuguuuucuacacugauguaaauaacugcgagugguguugcuccaguuguacaaguguguauuccucuaaggauugauggggaggaguguagagaacgggaaggaauggaugaguugcuuguuaagggaaaagaugauauucuuaugcuaauccaggcccuggauaaggagcagagcagccaugcgaacaauggccuuggagccaggaagucugcagugagucuauuccuucucagaaagcuugucagacccggcgccuggagcugccuggcggggagggaccccuggaaaggagaguuuucuccuugcuauuuuauggaauuggcugcuggccagcuuguuggaaauucccaaacuucucuacuagaaagugaaaaucaacgguggggggcuuaacaggaagaggaaggaaugacuuuacucuguagucuguuuuuucaacugacuucagccuuuuccuguguuuuuuuuuuuuuaaguuccaauugaacuguugguucaguugucuugcuguuugaggaguuuuaaaaucuuuuacuuaaaaaagaaauuauuuauauuugaguaauucugccuuaauguuauuuuccugaaaagaaacaguaccagucuguguauauagcaaggggaaguaaauuuauuuagaugcccauuucgucuaacuauucaauagcuuuuaaauggcagcaugauuaaaaaauuuugauuaugcagcaugucaaauaucugcaucuccuuauauucuucacuuugcaagauuagauauuuuuaauguaaaaauuccgaugaaucauuuaggaauuuaaaaaauauauuuuaucguuagauauuacaauuacauaauuuuaagaaugauuguggccaggcacgguggcucacaccuguaaucccagcacuuugagaggccgagguggacagaucgccugagguccaggaguucaagaccagccuggccaacauggugaaacccugucuauacugaaaauagaaaaauuagcuggacgugguggugcguaccuguagucccagcuacuccgaggcugaagcaggagaauugcuugaacccaggaggugaagguugcagugagcagagguugcaccacugcaguccagccugggcuacagagcaagacucugucucaaaaaaaaaaaaaaaaaaggcuggacguuguggcucacaccuguaaucucagcacuuugggaggcagaggcgggaggaucaccugagguugggaguucgagaccagccugaccaacauggagaaacuccaucucuacuaauaauacaaaaauuagcugggcgugauggcgcaugccuguaaucucagcuacucgggaugcugaggcgggagaaucgcuugaacccuggaggcagagguugcggugagcugagauggcgccauugcacugcagccugggcaacaagagugaaacucugucucaaaaaaaaaaaaagaauuguugaaaaauaagguuaauauuuugcuaugugauuguagaaacaguuaauaugagacaaaggagaagugcucaguuauuaauaauuacaucuguuuguugaaauguuuacugagauguaauauuacuaacucuuuugaguuaguaauauccccauuuuguggugaaggaaaccgagaccuggauagcuuaaguaauuccccaaaaucacacagcaaauaaauacuggagcugauuuuuaaaaauuauuuauauuuauuauuuuaucagugaauaccacaucaguguaugugguguuaacgccuuuauuaaugcaguuuuuagacgaaugguguucuggggcccuccccucuuuucacucucuuggaaggccaucuccagagucauagcugaauauuaccguucuuuuagcauaaccgauuuguauguucagccccaaauguguccuuuaaguuucagaaccaaaugcccguuagacauucccuuuggguaaucucagaucucuaaauuugaaccuuugaucucuucacuccugucaaaaucacucauucccauuucaauaacuguucaugccacagaugugggaaucuucuuugacgccucacuuucccuuacccuacauuuaauccauugcuaaguaccacugaguuuuguuuuguuuuguuuugagacaaggucucgcucuguugcccaggcuggagugcaguggcauaaucaaaguucacugcagccuugaacuccugggcugaagagauccucccaccucagccucccuagugucugggacuacagguaugcaccaccaugcccagcuaauuuuuuuaaguuuuuuguacagaugaggucuugcaguguuucccaggcugguguuaacuccagaccucaagugauucucccaccucagccuuccaaagugcugagauuacaggugugagccacguacccagccaaaaauuauuuuugaaguauagcaugaguccauccacuauaccacugccacccuauucuuuuuuuuuuuaauucauccaucugcacacggauucugcccuaaucuuaaccaccauugucauucuccuaaauuuccacaauauucugcuuacucaucuguuugcuuuugcuauuauccccuccaguccauuacguagaagucagaugaugcccacuuaggcuuaaaucccaaguccuucauaugcccuugccugaucuggucuuugucuucucugccucuucacccucaucucccacuacacuaucucuuauucucaacauuucagacauuguucucucuuugcuuuucucucccucaagaucuuugcccacgguguucccugugcuuagaacuucccgucuuucuuugccugacugacucuauuuuucagaucucaacuuaaaggucacuucucagcauugcuucccuuuccgcuucaucuagauuagaggggggucacugccccuauuccuucaggaccuggcacuuuucuuccuuugcacuuaucaugaguuaugauuguguaucauuuguguuuucuuguuuggugucuugaguaucuuaauuguuuuguuuaaggacucugaacuucaugaaggcugggccuguuuggcucugaacaguguauucuugguaucuaauacagaaucaugcauagcacagacacuuaauaaacauuuagggaauaaauuaauaauucaacggcaagaacacuguuuccauaggacuccagcauuggaagggauaacguagauuauuuagucuagggccaggcggugguggcucacgccuguaaucccaacacuuugggagguuuaggcggguggauugcuugaguccaggaguucgagaucagucugggcaacauggcaaaccccaucucaacagaaaauacaaaauuagccaggcuuggugacacgugcuuguggucccagcuacucaggaggcugaggugggaggauugccuggagcccaggaggcagugagcugagguuguaccacugcacuucagccugggcaacagagugagacucugccuccaaaaaaaaaaaaaaaauuuaguccagucucccuuucuaucauguuggucaugucuuugacaaagaugcucucaaacuuuauuccuuauguacucugugagcaaagucccuggguucuuuugguuguaucucaaguggagugguugcuauguccuuugcauuccugucauucuucucucaagugcuuaggaggccuggccagguggaauacaguaagaugguuguccuguuugauuacagcagcauuucccuucauucucagacugcaugcaugucuuaggaguugucaucaauaccaauacguauugagcucguagucagggaagauuugauggcuguucuccauacaaguuaucacagcuuuuuuugucuauaaaaauuucuugcagauugaauuguuauggauagcaccuguuagugacuuccuuugccagguuggcaaguguguuguaaacauggaugagaggaggaaacuucuauuuagcaccuacuauguaccaggcucuccuaaauaguuuaaaauguguauuuacauuauauaauauauauaaaaucaggcagggaaguauaggauaguuguuaacauguagaaucuggaaucagaccuccuugauuuuaauuaugacucugccacuuaaccuguugugugaucuuugauaaguuccuuaaagucuacuugccuguuucuucaucuguaaaauuaaaauaauaauuuaaccuuuaaauaaguugguugaugguuugauaacuuaauauaugcaaagcauuuaugacuacuggcacauagagguuaauauguguuagcuauuauuuuauaugaguuccuuaaguuuaaaaauauuuaaauuuauuuaauuuuuuauuuuaaaaauuauuuuaaauauguguuugcuguuaucucauuugguucucaaaauaacugucaguuaauaaauaucauuccagauuuguuuguuuguuaagauggggucuugcuguguugccaaggcuggagugcaguggcucuuaacuguugugaucacagugcauuguagccuggaauuucugggcucaagugauccuguuugagcccaggauuacagcugagauuacaggcggucaccaccacaguuggccucauuccaguuuuaaagaugaggaaacuaauucagagagguuaaguuaaaggcagauccagaauuugaacuuaugccaggguagcagggucguggauguuuuugcggaaggaacucacacacaguccuuuccucugaaagggaaagcacuuagagucucacggccagccagcucugcagggugccuugguuguggcucuaaugagacaaggccacauauuagcuuuaaauaaaccaaugaggaaacagugacaaugaaagauguaacaaggcauagcggucagucuccugcccaagacugugaguuccuugcagcaggaacaaccauacucauauuuguauuucugguaccuaacacugggucgguaauacguacuccagaugcaggccaguugcagugguucacaccuguaaucucagcacucugggaggaggccaaggccacaggauugcuugaggccaggaguuugagaccagcccaggcaacauagcgagacccaccgcccccaccccuauuaaauuaaaaaaaaaaaaaaagauguuguuggugaauaagugaguaaauuaauaagugaaaauuuggggagggguggagaccuagcaagggaggcaggaccaaagccaggguuucuggcaugguauccacuggagagugguagccaguggaggagcaagaaagaaagguguggguuugauuuagacagguggagugugauucuaguagaaauauuuagugggaaaauugaaaugaggaagagagauuaggauuggaaauacacuggaaacuucucuugaauuggaaaccuggaacauauauccuuagaaugacaguugaauuauuucaagaaguuuucaaagaaaugcuguuaaaucauguggcagacauuauucuauaguuauuuuagacuuuacaucuuuuucucucagcauuauguaaugggaaacaauuuuauauuacagaaauaagagauugcagggauuuuuagaacuaagcuacauauaacauacacguguaaaugauaccucacuguaaaccuucuuugccucaguacugugaauaacuuuggaaagcuaauuaaagugaaaauucuuacuuagauauuauaaaguagaaagcucagguuauuaauguagaaaucacaccagggucauugugucauaaauaagcaagaucuuugucauucaggaauaguucaagcugaaagucaauaaaaucaaaccacaugaaacaaugggauggggguaaaguagaaugauauauaucuugauacuaauuagccuuuucccccguuauuuauuuaacaauuuuacuuugaggcauuuaaaaguucacugucuauauuaauaaucaccaaaccuuaauuggagagauuauguuucaugucauccauauuagaaguucaguuucaucuuaauaaagucaaauuugcaauauuuuaggaaauaauuucuuuaagauacugcuuuuuucccuccgcuccccuccccuccucuccucuuuuuuuaugagauugugucucacucugucacccaggcuggagugcaguggcgcagucucagcuuacugcaagcuucgcuuacuggguucaagccauucuccugccucagccuccugaguaguugggacuacaggcgccugccaccacaccuggcuaauuuuuuuuguauuuuuaguagagacgggguuucacuauguuagccuggauggucucgaucuccugaccucaugaucugcccaccucagccucucaaagugcugggauuacaggcgugagucacugcacccgaccuucuuuuuuuuuuuuuuuuuuuuuuuuuugagauggagucucgcucugucguguaggcuggagugcaguggcacaaucugcaaucuuggcucacugcaaccucugccuccuggguucaagugauucuccugccucagccuccugaguagcugggauuacaggcacccaccaccaugccuggcuaauuuuuguauuuuuaguagagaugggguuucaccaugcuggccaggcuggucuugaacuccugacuucacuucaggugaucugcccaccuuggccucccaaagugcugggauuacaggugugagccacugcaccuggcuccuuuuucuuuuuuuuccuuuaaugaugaagcacccucuuuaauuaaauauguguaauuuucgccuggcauggugacucacaccuguaauccuagcacuuugggaggcugaggcuggcggaucaccugaggucaggaguuugagacuagcccggccaagauggugaaaccccaucucuacuaaaaauacaaaaauuagccgagugugguggugcacaccuguaaucccagcuacucagaaggcugaggcaggagaaucacuugaacccaggagguggagguugcagugagucgagauggugccauugcacuccagccugggcgaccgagcaaaacucugucucaaauaaaauaaaauaaaaugaauuaauauguguaauuuucuaggucggcuuccucuucuaucuauagaauaaauuauuuauuagaaagacuuaggguguuuucauuauaucuacuagaauuugcaagaauguugaugguuacccuuauguuuuaaauuuaacuuuuccuguuuaagucuuaauauaguugggaauuuucauguuauuaauaaaauaauuagaacagccagaaaggacuauugagauuguuuaauauacuucccuuguuguacauauggcuaaucugaggucaggagagguugcagccuauuaacuaaauuauuugaaguuugaaauuauagugccuaaaaaaaaaaaagcaaggauaccuuuaaucuuuuaaaauguauuucauuguuuaaagguguguuugggcauuuguuucccuuuuaguuuuugaaaaauuuccaaaauucaguuguauuccuuaccuuuuaaauauuuuugucuuucaggagucguaagaaagcagugggaguugaagucauugucaagugcuugcgaucuuuuacaagaaaaucucacugaaugauagucauuuaaauuggugaaguagcaagaccaauuauuaaaggugacaguacacaggaaacauuacaauugaacaaugccucagcuauacauuuacaucagauuauugggagccuauuuguucaucauuucucguguucaagguaaaucaguguucauuuuaguaauguauguguguauauaaaaagcacuauuucuugcuucuguucuuucaacucaucccuguuugaauaguuaggcccagccuacuagggcagcuuuuaggaaagaagcaaagaugaaacacgugccaaauaauuuuuuaacuuggcugugauggaaacauuuucaaguauuuuugaaaucucagucugagucugucuucuccuucacaacauaggcguaaugauacacagcauuaggucuugugaggauuaaaugagauaaaguauguaaagccaccucaguuaguagcugaaagacaggguaauagguaguccaggcugagcuucaaaauuccucucuccuuuaaaauacaauaaggagcaaguguaaauaauaauugaaaaaucauuuuauuggccaggcacaguggcucacaccuguaaucccagcgcuuugggaggccgaggugggcggaucaugaggucaggaguucaagaccagccugggcaacauggcaaaaccucaucuuuaccaaaaaauacaaaaauuagccgggggccuguaaucccagcuacucgggaggcugaggcaggagaaucacuugaaccccgggagguggaagcugcagugagcugagaucgcaccaaugcacucuagccugggcgacagagcaagacucuugucccugccccaaccaaaaaauuucauuuuauuguuguuaaaagacuuuagaaagauaacugacacuugucugugcugaauacuaaaauuucuucauagagcacugacaguuuguuuaugaccaauaaaguaauuuugcuacuauguguucacagcuuagaacucccaaacaggaaguuauugugaugacucuuaggaccagauggccuguauuugcacauaagcuuuuuccuguaugguuuaaguaggauaauauuuuaagcugaaaagacaguacuguuuugcaagaggauuuuagauaaaacuuacuggaugucuucguucucaaguuuuuuacuucacagguugcuuuuuccuaauguuuugaucacagugaucuggauuaauaucugcuguuaagaagaaacaugauuaacaccauaaagcuuuugauauuuucaucuuuuuuuuuuuuuuuugagacagagucucgcucugucaccgaggcuggaguacaguggcgccaucucggcucacugcaagcuccgccucccggguucacgccauucucuugccucagccucccgaguagcugggauuacaggcgcccaccaucacgcccagcuaauuuuuuguauuuuuaguagagacgggguuucaccguguuagccaggauggucucgaucuccugaccucgugauccacccacuucggccucccaaagugcuggcauuacaggcgugagccacugugccuggcugauauuuucaucuuaaagcacaaacauagaaugaaaucuauagcuucuuuuuauuuugccuuaguauuauaacaauauccuuaguauuacaacaauauccuuaguauuaccaugcuaagaauacagagccuucagcaaaagccacuuuuacuugugaaacaccaaauuauuuaguacaauaccuuuacuucaauaucuguuacaugccuuguugaucagcaucaaccaaagcugcuauaguuuugaagaugaguuaaauucauaguaauauuauauuugcuaccucacuuccagguaaucuccauuuuggcauaaauuuuuuuaaaaucuguuuagaucacacguaggcaauaugauacaaaauucucagucuucgccccaguucacauuguucuauaauaaacuuuuauuagguggaauaaguugguaauuaguuacuacguaaaagcaaaagaucuuauuaagaauuacauuucucugauaaagagugaaauuuguuacauuuccuuucaaaaaauuauuuugauaguugcuucaaauaacacacaaauguuugcucuuaaagcuaaaaccaauguagaaaaguuauuucugagagaucauuaggaaggauuguagaaugguauuaauggaaauaacuucugacuuuagcucuagcuuuaucuuguuuugaauuaugucucaggaaaauaaacuuaucuguaccuugguuuccuugauguaaaauagaaauaauaaugcuuauccuagauauaaacaagaauguuuugaccaucaacuguuaggguauagauuuaagugcuuuacauugagauaaaguuacuuagguuugaacagaaaaaugagucaucugauauuaacagcugauagauacuuaguucuuauuuuuuaagacuuggucacaaauuuuacaacaggauauauuaauguuggauagauauguagucccuuuuuuggauuuugucacaaauuucagaaauggauuuuaguuuuaaguaacuaauaaugacuucaauagagauuuauuuuuaacauaggugguagauguuugcuguacauucaguuauugaguagugucaaggcugacaugucuguaauuuucuugacauuucccuugugguucccaagugguuacuauuaucugcauuugaggcagguaaaacggggaaagggucagcacuggccucaacuagaccugauaccaggaaagcaaaagugucacagauuuugucuuaagucuuaaucauuccuaauagcaagagcuacuggaaaacagagaaacaggauugucacaauugucuuaaucuauauccauugccuagggcuggguguguuguucccccaaacaaaaucagaguuugguuagcugggaaaagggggaaaauagguaucaauuggacaauuaaaaggaucugggagagauuuaauuuuuuccaucaauuagaauguuuuccucuacaaauaauuaaaaaaaaauuaaaagagcuuaaacaugacauuuugggcuaggugauuuuuauuuuuuuaaaaaaaaguuugaacaauaaagagcauguaguaacacacaggaagucuguauauaaggggacuguaguugguuauguggcucaucaagacccaaguucuuugucuuuucaacugugacaucucuaaaugucagguuagccacagugucacaguguggcugcugagagacuagacaucacaugcagaugagguaagcuugaguugacaaugcucaguuaaagaagagggaaaucuguuugugucucuuuuuaauugauaaaucuuuccccauucacucacuuccucuccccaacagacuuccuucuaaucuuaguggccaaaauucauuauaugcucuuguguuaaaucacuggcaaggggaauggaacuaaaauuguuggauuagaccaacgauuaucucugcugagaguagagggcugcgcuucccugaaucacguggaggaggggcagacccuuaauguguguguacaugugcacaugccuguugccagcaagggaaggaggagaagaauaagaguaucuguugcuggguaccacauuuguugaccugacaucauacauaugcuaaaaugcucauguugcuaugaaauuuucaguuccuuuucaaaggguucuauaccccagaguugcauccauuuaguacaugcagcuacuaauccaggacuucuggcuggugggaagcccucuccuucggguccaggugccucuucaugguccagcaguguguggcuaaaagcaauuaucagugcacaguauauccaguauccagugauaaagaugaagugggauaaguacuauauaaaacuuccauucagaggaagaaaaauuggaaacaaccucaguauucacugcuccauagcauguagauuaaugaugcuuaaccuguuugucagccuccaguuuuauuuucugggaggauuugccuugucucugguguuccuuggcuaguguuucugucuucauggucacaucugagcuggaauuaguggaggaugaucuuuguggagacugaacagcuuuagcggccugcuuucuguuaguauggaggucugauuacuggaaauuguccuauggauugaaaacucacagccugacugagucagccugggauaucuuuggaaguacaguuccuguaaaguuguagugguccuacauucuguuugcucugaucucuuugguuucacuccauuaaacacaguuaaauaucuugucuugauguguguucugagaauuucugaccuagccacuggccucugcuuugccuguucuccuggccuuugguuuagugaccuccgcucugaggcacucugcuccuuucccaugcuagaaaaugaccugcuuuauuugguauuguagcacuuaccuaugaauaaauauuaaaauaguaccaaaugucaguauuuauucaucuuuauugucuuucuccgucgaagacuguaagcuuuaauagauaugggacuguguuuuguuuacucuucuagucacccagggcuuaaaacaguggcuaccaccguguacucacucaguacauuuugguuuaauggaugaauacaguuaaagugaaaaaagcaaguugcaaagcugcuuucuuagccauauauuuuuacacugaccaacccaguaacaacaagcaccuguaacaacccaguuguaguaucugauugucuuuuuucacuaaggaucuagaacuccuuggagaaaucacugaguucaaguucggcagggaaagagcaaggugaucuugguauuuuggccagaaagcaaggaaaaguucaaaggauucagugaccaguuugaauugaauacuaauuguaguggauucaaacaaaucaaauauguuuaaauccacguguuuguaauaacacuuaagaaaaaaacuaguuagggcugagggcugugacuuacaccuguacaugccaacacuugggaggccaaggcaggaggaucacuugagccucaagaguuugagaacauccacggcuaaacugagagucccuuuaaaaaaaaaauaguuugagaccagccugggcaacauagagcuggucucuacaaaaaaaaaauuuuaauuagcugaguguggugaugugugccuguauuccuggcugaggugggcgggagaaucacuugagcccgggagcuugaggcugcagugaaccaaugaugacgccacugcacucuagucugggcagcagagcaagacucugucucaaaaaaagaaaacaaaacuaguugguuacuguuaaaagaugcuaaugaagucauuaauuuugaaaacugguaaauagagggagaaaucaaacauuaaucuugccuuucuaacaugaacugugccaccuguauccaauuaguaggugagggaaagcaucucauagauguauuccaagucauaaaaaagagaaaugauaggauuagauacauuauuuuauacuaugccgauugaauuagugaaucuagaccuuaaaaacagagauaagcaggcauuugguucccuccugcccacaacauacagagcagcugcauuucagcgcucaauagacacaugugacuuguggcuaccauauuggacagcacagcucucgagcuaauuaccauuuacaaaauccauagagaacaagaggacauguuaaaugaugccaggaggaugugaucagaaauuccagacugugguaaauacuauacuaguaaauaccggacaaguuacccaaugucuacaaguaaaucucaaggacaggaagaggcagaagaaacugguagauuaagagacuuggagacaaccagcuuauuuggauccugauucaaggaaacuacuaaaguaauuuguaauauuuaugauacaauuggaaauuagaaagcaauuuauaacauuuauaauauaauuggaaauuugaacauugccuugauguuugaugauauugguaaggauaaggaauuacuauuaauuuuuuuaggugugauaacuguguuuuuuuuuuaaguucuuuuagagauacacauugaaauauuuacagauaaauggacauaucugguauuagcuucauaauuauaugaaagggggagggagugaaacaagaagggccaugaauucaucauuauaaaagcugggcuguauggguauguguggguucauuguacaguuuucucuacuuuuauaaaagguuucuggccaggugcaguggcucaggaguucgagaccagccuggccaacauggugaaacccugucucuacuaaaaauacgaaaauuagccgggcaugguggcaugugccuguagucacagcuacucgggaggcugaggugggaggaucgcuugaaccagggagguggagguugcagugagccgagauugggccacugaacuccagccugggcaacagagugagacccugucucaaaaaaauaaaaaguuuucuggaagaauacuucauuucaaacauauauauguaaaugaauagaaaaaggacaagaagcauauacaucaaacggauaauggugguuauguuuaaggagugggaaggggauuagaugggcccaaagaggacuuuuugguuuacuuguggggcucaauuuuuuuuuggaugcuaugagaauauauuguuguuuuauuugaguauuuuaaaaacuacuuuuaggaaaaaaaaaaaaaaagacccaacacgguggcucaugucaugucuauaaucccagcacauugggaggcugagacgggcggaucaccugaggucaggaguucgagaccagccuggccaacauggagaaaccccgucucuacuaaaaauacaaaaaauuagccaggugugguggcacaugccuguaaucccagcuacucgggaggcugaggcaggagaaucgcuugaaccugggaggcggagguugccgugagcugucaugccacuguacuccagccugggcaacaggagcgaaaacgccaucucaaaaaacaaacaaaaaaaccaucaaaaacuacuuauaggaaaaauacuuauuucaagcauaugucuaaguagagagaauaauauaaugaaacuccaugaacuugucacucaguuuugacaguaucaacugaugaccaaggcuguuuccucucuacccccaugcacuucucccucacccacgucacccuuggauuaucguggguaauuuugaaauaauauuucaguuaaguauaagacaccuuggcugggcacguuagcucaugccuguaaucacagcauuuugggaggcugaggcaggcagaucacuugaggucaggaguucaagaccagccugccagcacuuugggaggccgaggugggcggaucaugaggucaggagauagagaccauccuggcuaacacggugaaaccccgucucuacuacaaauacaaaaaauuagccgggcgugguggcgggcgccuguagucccagcuacucaggaggcugaggcaggagaauggugugaacccgggaggcggagcuuguagugagccgagaucacgccacugcacucuagccugggcgacagagcgagacuccgucucaaaaaaaaaaaaaaaaaaaaagaccagccuggccaacauggugaaacaccgucucuacuaaaaauacaaaaauuagccgggcgugguggcaggcgccuguaucccagcuacuugggaggcugaggcaggauaacugcuucaacccaggaggcagagguugcagcgaguggagaucgugccauuguacuccagccugggcaacagagugagacuccauuucaaaacaaaaaaaacaaaaagcaaaauuccucaaaggccacauacugugaucauaaugcaauaaaaggaguucaacaguguaaacuuuguuugagcguaugacuuuuuuuuuuuuuuuucuauuugagacgagucuugcucuguggcccaggcuggagugcaguggcacaaucucagcucacugcaaccuccaucuccuggguucaagcgauucuccugccucagccugcugaguagcugggauaacagguagacaccaccacacucggcuaauuuuuguauuuuuaguaggguuucgccauguuggccaggcugguuugaacuccugagcucaggugauccacccaccucggccucccaaggugcugggguuacaggccugaaccaccauucccugccagccugcuggguucuuaagcgauccuuccgccucagccacccaaguaccuggaacuacaggugugcuccaccacacgcagcuaauuuuuuaaauuuuuuguagagaccaggucucagcauguuucccaggcuggucuugaacuccugagcucaagcauccuaccuuccuggaccuccguaagugcuaggauuacaggcaugagccaccaugccuggcaaacacaugauuuuuuuuuuuuuuuuuuuuuuuuuuuuuuuuuuuuugagauggagucucacucuguugaccaggcuggagugcauuggugugaucuugucucacuacauccuccaccucccugguucaagugauuccuuugucucagccuccugaguagcuggauuacaggcucacagcaccaugcccagcuaauuuguuguauuuuuaguagagacaagaguuucaccauguuggccagacuggucucaaacuccugaccucaggcaguccacccgccucggccucccaaggugcugggacuacaggcgugagccaccgcgccuggccaagcauaugauuuuuaaugcaauaacuauauucauguuucuagaagcuuuuuuuugccauucagugacauuauggaugacacugcaugucaguaugugucggacaugugucagcaugugucggaauguaucaacccauuuuugauaauggguucagaaccaaguuugauuaauguuaacugauuuaugcaguuuuuauguucaacugaaauacaucuaacuauaauuuuuuauuggccuuccaaaagugucauaaaauaagccuaaucauucacauauccuaucagaugugaaaagcccauuucuaugcuuucuggcccugccgcaaaaucuuuucuuuucuucucccuuugauuuuccuccuagaccaacguaguaugacagaacuuuguuuggugauggaaauuucuauaucaguaauuugcaaacuauagcccacaaacuaaauccagcgcauugcugcauuuugugcugcucaugagugaagaaugguguuuuugcauuuuuaagugauugaagaaaaaucaagggaauauuuaaugacacaugaaaauuauauggaauucaaauuuuauuauccauaaguaauuuuauuggaacacacucauguucauuuuuuuacauguugucuggcugauuuugcauugugucggcagaauugaauaguugugacagagaccuuggggcccacaaaaccaauaccuguuuucuauaucucugcugucuugugugauagcuacuagccaaauguggcuuuugagcacuugaguugugacuagugugggugagaaacugauuuuuaauuuuacuucauuuuaauucgucuacauuuuaagucacauguggcuaguggcuaccauaugggacagcacaguuguagacaugccaccuuuucccuaguucuugcuuccuuguacuugacuuuccuucugcugaugucuuccugguuucuauuuaauuaaugaugcagacuguuguugcagaauucauuaggcuaccauugcugauuaucucauauguauagugcaucaguagcccauuggucucaccaaccguuugccaucugaguucuguuguagacauucuaucuuaagguugcggcagagggcauuuauuugcuguagaaaaaggaagccaauaaauuauugggaaaauaugaaaaauuacuuagccaggaauaaaaaucuaguaaaaucauugaugccaaaaauugcuguugaugacaaggaccuguaaaugugccuguguauggucaugugucucuuguaacuguuugucucuuuguauguauauguuuucauuuuuuccugagauguuauacuuaaacauguaagcuauuaaauauuuuguguguguuuguuuugaaauauaaccuauacccccaguccaccccagggcucguaguuuauucuuuguaaauacacgggacuuguggguggcgagagauugacauguucagaacugacagaaggccaugugccaaguaaagugaugauggugaggccugcaggacccagauccuguugggcccugggagcacacaguggagguuggauuuuauucugagugcauuguggagccauugauugguuuuauauaggagugacagauuuguguuuauaaaaugucucuggcugcucuguggaaaauggauugcagggaccaagagcagaagcagagggaacaguuggagacuucuuaccuuaguagaggcaugaugugaugggccuuggugacaacagcggaguuggagaaaaaugaaaacaauugacauacauuuuggagguugagccaaaagacuuugguaagaccagguuugaggcaaaucaagaguucauuuaagacaagucagucaggagaugucuaagcaggucauggcuagaggggguacauccaggaaccaucaacagagugggcgcuguccccuagggagagcacagagaggcucuuuccuguuacuuuucuuuguauucaauaucugcuuggugaaaucuugcaaguuuuuaagauguagcuuagauuucauuacuuuugacaccuaagaucaguuugaguuugacaccuaggaugagccuuuuccuuuguuuacauguaaacaccuccguauuuugucacuuuuuuuuuuuuuuuuuuuugagauggauuuucgcucuugucgcccaggcugaagugcaauggcuugaucucuguucacugcaaccuccaccucccaggucaagugauuguccugccucagccaccugaauacugggauuacaggcgccuugccaccacgcccagcuaauuuuuuaauauuuuuaguagagacgggguuucaccauguugaccaggcuggucuugaacuccugaccucaggugaugugcccacuuuggccucccaaagugcugggauuacaggcgugagccaccgcgccuggccuuuguauuuugucacuuuucacauuguauuuauuugcuuuugugcuuauucccccucugcuuuccaccaaguuucucaaggccacauaugugguuuugaugccacaucuuugcguuucuagcauuuaauaccuugccugcacauaauagaccccuacuaaguauucuguugaauauuuggcaauaacauaagcuccagauacaacuacuguaauugaguuuuuugucucaugaauucaaauaguauucuaggaaguuucauauaacuuugaguuuuuucauguaucagugaucuuuuaguguucugaucuuuguuauuaguaacaucuucauuuguauacuauuuuacauguaguuaagcacuuuaguaaauauucauuugaucuaccuauaaccucuugauuugaauuaggcaggaauuauuauccccauuuucuauagauagcugagguucagagaguaacuuaucugugcccguaacugcgacuugaacccuucacuucuugcuguuaucucaagugauauuucugccacacuaaacugcuuuuucugugucacuagauuuuugaaaaaucaguugcugugauauauuauauacuguuuguuuuccagagcugaauugauacgugucuucuguuaauguaauaggauuuuaaagcuggucagguucccucaccuguccucuaguccuguagccuuauagaguaaaugaagccuggaaaggugacauggcuugcccaagaccauccagcuagguaaagcgggguaggcccauggcaaaacagaaucccagucuccucauuuccugcucaguggauuucuucccuuccuguaccuccugcuucccccaccccaucuuuuacaguugauguuucuaacauaaaggaggucuuuccgcuuuguagcaaucagauccaacggaagccuugacauuauauuacggaauuuauuucugaaaggagagugguguggggggcgcggggaugaguaauauauguauguacacaaacuuccagcuuuuuuuuuuuuuuuuuaaguguuuucucuccuggccgggcacgguggcucaugccuguaaucccagcacuuugggagacugaggcaaguggaucacuugaggucaggaguuugagaccagccuggccaacauggugaaacccugucucuaccaacaaaauacaaaaaaauuagcuaggcguuguguggggugccuguaaucccagcuacucgggagucugaggcaggagaauugcuugaaccugggaggcggagguugcagugagucgagauugcaccagugcacuccagcuugggugacagagugagacucuaucucaaauaaaaauguucucuauacucauucaguagcaaauucuuuuacuaaauauucgguauaagaaagugaagguuauuggccaggcauaguggcucacggcuauauucccagcacuucgggaggcugaggcgggaggaucgcuugagcccaggaguucaagaccaaccugagcaguauagggagaccuugucccuacaaagaauuuaaaaauuagccgggcaugguggcaugugcccuuggucccagcuacuccagaggcugaggugggaggaucacuugagccugggagguugaggcugcagugagcucugaucacaucacuguacuccagccugggcaauagcgugagaccaugucucaaaaaaaaaaaaaaaaaaagugaaaauuauugaaacugaaggcauguaaucaucaaaacacuauuuagcagcacuuuuucuguuaccugugugugcauaugugauauuuuuugucuuuucaguaguuuaucucaucaguaugguaaauguaaaaucaagucuguguugugucuugaaccacuuauuuaacauucauaaugaaauacauauacacuugucuguuugguuccaccuuucauucccuugagaguaacccacaaagaauggccuagcugagucagagagaggaaguaauuacuagaacaguuuuuuuaguuccguucugcuuccagccugaaagauuuaguaccaaauaugacaguaucugucacugcaggcugcuagacucuaguguaagaacauaguucuauuucugugagcuaacugcugcccuucuauaaccuucaguuucugccagcaucgucugcauucaaaccaaugaccucgaggugaaaaucuccagauaacaugauugguccccaugcucucaugauuuccuuacuuaagcaauuaaaggccaaagcaagaugcuuaguaacuccuuuuccacauagaggcacaaauaaaggaaagcuggucacaaguuuugaaccaaagaguuaaaagaagaaucauaacuugucucuauuuaaugauuggaaacucucacagacuucugugaagucucucccccuuuuguaccuuucuuacaagugaugacuauauacuuuuaccuggcaggggagagaccacggucacgaaggugguuuucccagggcgaggcuuauucauugcacuccagaugugcugaccccugcgauuuccccaaaugugggaaacucaacugcauaauugugguggugggggacugcguucaugcuuuucccugguuaaauuaaaaaauuuuuaaguuauuuuaaaaauauaaaaaacaagauuugacuguauucugccuugcgccacucuuguuugucuuucacuagugcaaaaauugugauauagcugucuucauguaccccgcaauaccuggugcaguaauucugugcauaauaauguaugucuguuuguuguaugaaugaaauuuauauuucuaaagaaacaugcuagcuacaauuauugugauaagaaagcuuaacaacuuuuucucauugaaaauugucacgaaacaaugagcuuuucagaaaugauuuacuuacaaauuccauauuugaaugcaggacagaaucuggauaguaugcuucauggcacugggaugaaaucagacuccgaccagaaaaagucagaaaauggaguaaccuuagcaccagaggauaccuugccuuuuuuaaagugcuauugcucagggcacuguccagaugaugcuauuaauaacacaugcauguaaguauuuuaugcagcccuucuuaagaguuaggagaauagaguugcauuuagugcuauuuuaagaauuauuaaacuugucugcgguuuuuuuuucauucauauauaguaucuuuccagaaagccaaaaagccuuuuguuuuguauauuagaacauuauuccauuaaaugauugauaggugaguuacuauauuagaauuauguuauaaugcagcuuuuaaaauaagaucaaagggaucuaguauuuaacaucugaguuuuuaaugaucuuuuaaucuuaaauuuauugaugcucauuuuagaaaacuuagagguuaccaaaaaagaaaucagaaaacucacugacaaccuccuacuucuuuuuaauuuaaaaaaaaauuuuuuuuuuaacuauagacaggaucuugcuauguugcccaggcuggucucaaacuccugggcucaagcaguccuuccaccucagccucccaaagugcugggauuacuagggugagcugccacaccuggccuccuacuucuuaauuaguugaaauauuuugcagauauauauaaaucauauuguguuaauuaauuuuaugcuuuuuucuuaccugugaauuuaccaauccaaaucugauuuauaaaaugauuuuaauuuuucuaguguauuucguguuagcugcacaacauguuuauauaugaucauguaauucuaguccauauuuguuggaaacauugacauauugacuuaauaagaccaaaaaaaauugccugaacaacucaaccucaucagucaauuaauugucuccuuguuauagaggcaauaaugaaugucauguuuuauacuuuuaauaauuguauguucccugaauggaccagauagaaagcaugaaacuuuacacguaaacucuugaaccugcaugacggucaucgugucuuagguuugcugcuuguccccuggugguggugggcucugcguggcugacugugacuaguuguucauuuuuaccuuggugagaguuugccagcagggaacugcucucugcuaugucaccaaauaauguuuugcuaaacuucuugucuguaguaccugccugauguaaugggcugucuguuaguagcuuaguaacccagaguaaaacugaaucauccauuuuaacagaauucugccccacacuuaacauuuucuccuaacagaaaaccaagaauucugcaaaauucuucuaaguagaagcagcacaauuccugauauuaacaauaaauaggaguacagaaaaagcuuuuagaaauuucucccauaccuguuaaagucuauaugaauauauuaaggggaaacuccaggaugcuaacacuaaaauaagaauuucauuauauauguauguaaauuuauugaaaauuuauucaaaaguccucucccuguuuucccaucauauucaguaaaaggugccuuuuaguccccuuuuuuuuggucauuaagccuauuuguauguuucagagaaaaguuuguuuuuaucuauuaucauauacaauauggaaguacugaaaaaauggguaaaaagagacaaaguuauuuuaaaguauguuuucaaaacaugacauaaaauuuuauaaaucagcuuucugugaucacaugacugauuagcaaagagaagucacauaacuccuauguggaggacuuguuuaauugaaauccuuuucuucuugacaaaggguugucacuggccuuuuagaucuuggcucagacauaacuuucauuugucuuaaaaccucuggcguugccaauaaaucacgugugaaugcaauucuaagucacaaaacaaaguauuaaaggccaucuguaccuguucacauucagacucaaauuucguuaguacuuucuaugugaauuuauguuuuguuuuguuuuguuuuuuucuguuuuagaacuaauggacauugcuuugccaucauagaagaagaugaccagggagaaaccacauuagcuucaggguguaugaaauaugaaggaucugauuuucagugcaaaguaagauauaauuugggacccaugagacaaagaagggaggggccauaugaaagcaucgauuucccccaggagaaacaugccugguguacacaucgcuguauguucacaucaguaaauauauuggaggaauaccuacugucuagauucuguccuguauucauauguagaauuuauaacuaaaucauuucugaaaagcuaauuguuugauuacaauuuccuuuuuuauuuccauagacagcaccuggcucuguugcccaggcuggagugcagugcugcgaucuccgcucacugcaaccucaagccagccuccugccucagccuucugaauagcugagacuacaggugcaugccacuauaccuggcuaauuuuuguauuuuuuguagagacaagguuuuaccauguugcccaggcuggucucaaacuccugggcucaagcagucugcccgcaucggcccgcaaagugcugggauuacaggugugagccacugugcccagccugauuacaguuuucuuuguucucuacuugggaggcugaggcagaagaauugcuugagccggggaggccaagguugcaguuagccgagaucguuccacgguacugcagccugggccacagagcaagacccugucucaaaaaaaaaaaaaaaaaaauucuuuuuucuuuuuuuaaauuuuaaccgucuuuggcuacugauuacaauuuucaaugagaaaaaguuucuaaacuuucuuaucacaauaauugcagcuaacguuucuuuaaaaauaaaaauuuuauucaaguaauaugauuaugguaauuuaaguuccagguuauuuuaccuuaaaaaaaguuuuaaaucauccuagguugucaugacugcaaaaaaauuauauugucacacuuauuuguagauuauaaaauuuacugagaagacuuuuaagauaguggcaguaaccuuuguaucacucugagacaacuuagaaauguuaaagauauacugcaaacucuaggguaaccacuaaaguugaaaaaaaaauguuaaggccuuguaaggaggugucaguggagcucuuuaaaagcagcagcaaaggaaucaggaugguaauaguuuaugagcauccugauggcucuggguuauaaaccugaucucuucaaaauucugcauagugauuuugucccaggagauccuuccaguguuucugaaaaccagcuccagauagaauuguuugugcauaauuuaagucucagcuauguuagaaaauuguuccuauuauuuggaaauucucaggauggaggccgggcgcgguggcucacgccuguaaucccagcacuuugggaagccgaggcggguggaucacgaggucuggagaucaagaccauccggcuaacauggugaaacuccgucucuacuaaaaauacaaaaaauuagcuggacgugguggcgggugccugucgucccagcuacucgggaggcugaggcaggagaauggcaugaacccgggagguggagcuugcagugagcugagaucgcaccacugcacuccagccugggcaacagagcgagacucugucucaaaaaaaaaaaagaaaagaaauucucaggauggauagaaaccuuaaagguuauguuucaaccucucagcuaauguuuggaaucacccuuguugcaaaugacugcaaaucuaucuuccuuucugacucuuuggaccauagagaacaaaccuaaucucucuuuaagaugacagcccuuuacuaaguaaaaaaagugcuucauccuacuagucuuugcccagugaaaauaauuguccauaaugaccucaacugcuccuuauaugaucagcuuuagaguuauucagucuccacuuccucaguguaauaugcagaauugagugugauaugaccaaggaaaaaaguagagaauaaauagcccuguucccuuuuucuaaacauagucuuguguuagauauuuggcagucaugccauauucuugaaccauugagccuucuguccgcugaagucccuaugcuacucacucaugcugcugcuaagccacaucuccuccacucuucauuggugcuguugguuucuucacacaaauaaguagaugggaauggaaugagguuuuccuauacaguuguuacauacuugucuuuaugaauuuuaucguauaagcauuaauccuuugcucuaauuuguugggauuuaaaggaugcuaauuucguuguuccaguuuuaggcuauuugcguauuuaucaagcacacauacuauacauuuuuuaaucacuuaaaaaauugaagaaagagcuaugguuaggguacugagcccagcaguaauaaccaguguucaacaggccccuaguguaggccuguccuaagcugaauucaccauuauaaguuaguuguuaaacuugacaagcuguucaaaucuauauacuauauaugugaaccuucggacaaggugcucugcucucguuuucucauccaugaaggaauuacuaugaggaucaaaugagauacauguaaauaguuuagcacaauuagcacauaguaagggcuuaauagauguuagcuuugaccauauugauucuuuaauagagcagucuucaugcuguuacccauaucccuggguacacucagacuguguuauacaaggguaacgggcacguugauaguuuuaagggaaucaguuuuuggauccuaaacuucaguagguccuguugcugaauauuucucugccugagaacagaacuucucaagcaguucucuuucccuuagucacuuuucauagucaaccccuccuaguuuacaaauagaaggccugagguguaaaacuucaagguuccaaacgguguuguaauucgaaguaaaggcaucaguguaggcuaugucgggauaucaaauaaguguuuacaugacagaugguuuucaauuguuugcuuucaaccaaguugcuggaucauugaaaauaauuuucgaugauaggaucuuuauggcacuuuuagcauaugcuuuggaaggacuuuaaacaauuaugggcugaucgugguggcacgguggccccagccuguaaucccagcacuuugggaggccgaggcgagcagaucaucugaggucaggacuuagagaccagccugaucaacauggcgacaccccgucucuacugauaauacaaaacuuagucaggcgugguggugcgugccuuuaaucccagcuacuugggaggcugagacaggagaauugcuugaacacaggagguggagguugcagugagccaaaaucaugccauugcacuccagccuaggcagcaagagugaaacuccauccaaaaaaaaaaaaauuaugggacaaugguauaauagucuccuuccgugaucaucaucuugcuuaugugaauacauugucuugaugaugacaaaaggaaaaauaagaauaagauuaaugaugaaucuucucacucuagcaguaauuuuuauucaugaauucgugaacugauuuguuucaaaagucccauccauaucauuaagaaaugccuggccaggugcaguggcucaugccuguaaucccagcacuuuuggaggccgaggcgggcagaucgcuugagcucacaaguuugagaccagccugggcaacacggcagaaccccaucucuacaaaaauuagcugggccugguggcucacgccuguaauucuagcacuuugggaggccaaggcagguggaucaccugaggucaggaguuucagacuagccuggccaacauggugaaaccccgucucuacuagaaauacaaaaauuagccgggcgugguggcacacuccuguaaucccagcuacuugggaggcugaggcaggagaaucguuugaacccaggaguuggagguugcagugagccgagauagcaccacugcacucuagccuggguaacagagcgagacuccgucucaaaaaagaaaagaaaaaaaaaaaaaaaagcugaggugggaggaugacuugagccugggaggcagagguuguagugagcugagaucaugcaacuccacucuagugugcggagugauagcuagaucuucuaucauaaaaaaaaagaaaaagaaaaaaugcccuuuccaauaacauuuucuuaaguuuguauuuaaugaagauuguaacauauauauuguuuugaucaauuuuaugcuaauaaugauuaugauaaacuagaauaauuuucuaagacuuaaagacauacaguuauaggaaauaaaagaauuuuuauguacuuaucuuugauguggacaguuauauauuacuuuaggacguaauuaucaugggagauauugaaaggaaauaagaguucaaggagaaauaagaguucuaguguaaaauuucucauugcuaaaagaagcauuuguucauuuauucuuuaaaaugaugauaauggguaucaaauugcaaugcuauuuagauucuacugaaugcauuaaaaaaugauguaacacuucuauuucaaaaugagguaacaauucuaugucaaagugucauuauguacaguaagccagaaauuauuaauauauugcagccauuuaaauuuauggugaaaauuuuuaagugucaccugaaaaauacgugaaggauacguugcuuuuaagaauuggguuacgccagcaagcauuuugaccagcacuuaucuaacuuucuguauuucuugguaaacgucacccaagcacagcacucacccaagcacagcucugucaugcucauccuaacccuuuccccagugucuucacgcacugccauguguggcacagaacagaugugagugccucucaccaggccucgcguucuuccacuccccaggcugcauugguaaauugugcuuauucuguuuccuccuauaggacaaauuauuuuucagaaaccucacugccauuccuuguaacuuggcgucaguuccuuccucauauacugucuccagccugagcacacugaauaaguuuauuuaagucagaaucacuuaauucaucagugccaaguaaauuuguuucccacaaaaauucauauuccccacauaagucuagaaauacaaaauugacuugggcagaggguacggguggagagugcaggaaaaggaaaggcugugucacccaaauucauaaucucgacaaacccaauuuuugccuacccagauacauaguuaaccugaguaagacagacgugagaugaggcagguguugcuuauucuuagugaagccacaaugggucuuuagggacuuagaaguuuuuuggcuuagucuagaaucucaucugggauucaugucaagcaagaggaagggaaguuaauuuauugaauauuuguuauauguguauaguauccuggggauucaguauauucuaccuuguuuccccccaacuacucuauagagcagauuuuuuuaaagacaggguauugcuccaucacccaggcuggagugcaguggugcaaucacagcucacugcagccucaaccuccuggguucaagugauccucccaccucagccuccugaguagcugggaccacaggcguguaccaccacaccuggcugauuuaaaaauuuuuuuagagauggggucucacuauuuugcccagccugaucucagacuccuccgcucaagccauucugccacuucagcuucccaaagugcuaggauuacaggugugagccacuguucccaguucaucuuuuuuuaaccuguauuuuuuagcacacuaaagccuagagauaaauuacuugcucaaguucacaaagugaacaacuggcaaagcuaggauucaaacuguuugauuccaaaacccuuguauuuucuguaauacuaugcuccuuaaucuguuggcagagucuauuuuuggcuucuuuuuaaaaauuauuauuuuuagagauagggucucacuacauugcucaggcuggacuugaacuccuagguucaagugauccucaugccucagccucccaaguagccaccacacccaguuuaaagucuacuuucuuucccuuuuaaagaaaagggacguauauaacacauauauauauaacauauauauaaacauauauacauguuuauaugaaauguuuauauaaaaauauaacauuccauuaucuauuguaguuuccaacacuccaucuuucuaaagucuuuaaauuacaccugucuuucagccaucucucuuacaagggcuuucaucuuccugggauauaauucaccuagguuagaauauaggaacucauaaggaauacaaacgcaucguaagaucucuucguacauuugggaugucguuucccacuuaguaguguuugagcuaccuucgucaucccugucagcauccuucauagagaagaaaaaacaagacaggaguugaagaauuguucguuuuucuccuuaucauccacugucaugucagcaguacaucuguugcuuggagaaaccccaugcugccaaagaaacccuuucuugguuuuucuuugcacuuuucucuucugcaaggccaagcucauuuuagcuuuccuggaaccguuuuuggaugcuugacacuucuuucauucaucguuaguuauaugauuuucauuuccuccuccauguguuuucucugaaucugggauuauuucagacucuccaguuuaacccuaacuuuuuucucucucuccuuaugaucauuuaaaaguaaaaauuguuuaaaaguuauuaauaaaacuucauuuaaaauauaaaauauguauuuggacauuuccaaaugcucuugaccaucuucccaacagaaucugaagucacaggcucauguuuaccuuuuuaaagucauagcugauuauacugaggcuuuuccuuaauuuccgcuuacauucuuguuacuuguguagugacaaacaguucuuugcuauucacauguuggucagaauggcaguucuccccaggcugcagcauucaacuugucagauauuguguuguuaauccaauaaaacaucacaugcaagugcugcugcgcuuccagugacuguguccuucucugugcuagcuuucugcucucuuagggacagucuccuugcuggcugguggucuguaaucagcucucaagaaugcuuucuguaguuuguccuucccucaccauggaugcucaacuugccucugcaucaggcucaugacuuccgacguggcugggguaggcagggucugcagcgccucugcacgcucagcugccuugcuaaccagccuuuucuuuggacuacgacacccuccacuuuuuagucugaucuuaaaucucauccacaucucaguaccacagugagauuauauguaccagaccaguuuaugauuguaauuaccuaaguucggguuugguguucuaaucuagugucuaacacaccauccacauagauauguucuuaagaaaagccauuuugcagucuucacuauuucagcacaaauuuuaaucuuucaauaaucuguuuuuacauauaaaauuugcaggccccuuucacucacugaaauagaaauuguauuuuaugaauacuaaaaagacauaucaguuuaaaauaccaaaccauuucuaauuuuaucauuacucuucuuuuaggauucuccaaaagcccagcuacgccggacaauagaauguugucggaccaauuuauguaaccaguauuugcaacccacacugcccccuguugucauagguagguuagccgagaaaagucggagcaugcuucucaaauaucuucucugguuuuacaguaaccaggcuaccuagaauugaacacgucagauuauuuuuucauuucaauuguuuacauuguuuacuuuuauugucagguccguuuuuugauggcagcauucgauggcugguuuugcucauuucuauggcugucugcauaauugcuaugaucaucuucuccagcugcuuuuguuacaaguaagaagauauuuauuuugaagcaaaauauuuugucaaauauuagaugucaaccgcuguuuguaaagccaguugcagaaaccauuaacuuguauucucugguuguauaucuccuuuauguaacuagacuauaguucucuuaagggaaaaggaccuuacuaccaauuaauuaauugggcacaauuucauacuucuuguauguucaugauuacuuaugauuuucuuauuaauggaauagugagcuuucuggcaucugaauguuuucgaucugucccaagaaacccacuguguuauaauucuuuuuuuuuuuuuugcguuauaauucuuuagaaauuuggagcuccagaauuguuugcauguagccaugauuucagaagacaguugccaaaaaagaagaguaauaagagacagucccuaauggauauaaacuuuaauaauaaaacaucauaccaaccuagauacauuaaugaaacaaguuaguaaacccauaaauaaacaaacccaaguacauacagcaauuuagcauauaauaaaggaaacacuucagauuacugaggaaaagacguucgcauaccuccuuguuuuuauuauaauuccucacccucaacaaugggguaccacaguugagaaaucguguuuugggucuuucuagauaauagacuuggaaucuucuguuagggaggugaugcgaaagucauaugauuauucagaguaggagauggggucgagaggagagcuccacaucugagguagccaucaucccaaauggcccccagugauucucacugccugggguuccuccccuuggggccaguccccucccauaacacaucagggcugaucugugugacaaauaggauauggcaaaagugacuuccaagucuacguuauaaacagcuuugcagcuuucaccauggucucugggaucacucacucugggggaagccaggcaucaugcuauguggacacucaacucugagagaggcccacacagggaggaacugaggccucuugccaauacccagccugcagccugucggccuuggaagugagccaccuuggaagugacugcaagcuccugucaagcuuucacaugagugcagucucagcugacaucugacccugagcuacccaaucaagucacuccugaaugcaugauccacagaaacagugagauaacaauugcuguuuuaagccacucaguuugggagugauuugcuaacacaguauuggauaauccaguguccgacuuucugaaaauugacuuucaagcagucuucuugguguuauugucacccucaacuuuacuuccagacauaaccacaauggccaguuccgaaguucuugggggaacuccauaguauaaacugguugcuucuugguuuucucaauuucuaaccuaagaaucagacuuuuugggugugcaaagucacugcucauucaucugcuucaugaauuccaacaguguuuacuguuauuuuaucuccuuuucuccuugccuguuagauaaagaaguuuaaaacucuuuauugcuguuuuaguggacuaguaaaagcaagcaaguaugcucaaucgguuauuuuaagcucaaagucccuuugucaaauaacugaaucuuugccaguaagacaggugauaauaucucaaggugauuuuaauuuauauuuucauauuaaaauacuuuuuuuauacauugguuucuuuauuacacaagggcacuguaauguauauauuauuuuauuuauuuauuuauuuagaaauagagucucacucugucucccagguggagugcagugaucucggcucacugcaaucucugccucccagguucaagcgauacucaugccucagccuugcaaguaacugggauuacagguaugcacugccacaccuggcuaauuuuuguauuuuuaguaaagacggggguuucaccauguugaccaggcuggucucaaacuccugaccucaagugauccacccaccucgcccucccaaauugcuggaauuacaggcgugagccaccgcaccuggccucuaauguguauaguaaaauauuguugaguaugcuuuuauuuuucuuuuaagaaaagaaccaucuauauuuuuauuuaaaucauguauucauuuuggggggccuguuuuuccauugaauugcauagauuuuuuucucuuugauuuauagaagcucuuuauauuucagaaaucagcccuuuguaauaugagcuaccuauacuuuucuuuuuuuguuuuuuuuucaugcugcguuaccucagagcuaccuacacuuuucacuguggugugucuugagacugccugcagugccuucagccacauaguaaagaacccuaucagccaggugugugcucucuaagcaauggguaggauguuucuuaaggaaaucuguucagcccaagagauaaaaccuaaaaauacugcuguuagggcccagugaaaugguccaggcagauuaucuuacagugaagcuuguaaucaguaaacccuacccauauacuaacagcuugccaaucaaggugucaggcugugaaggauacugaucucugagaaaccagaaacaagugaggugagccuugugauugcccaccuucuucucccugaacagaguuucggguugggcaucacagggggaacccagguguagccaguagccugucucaguucgaagaguugugaggaagcuaccaagccuagggaaagagcaccugaaaugauugagaaaacaguguuuggugcucacacaaggcugggaguaggaucuguucacaccagcugugagaguugaaaaccccauaauucauagguuuugguugaaggacucaggaggauuuugccucagugguggggaauaauuagcccuagacuaaacauggcucuggucucacccuaaaagcaagccccaaacagaucacaccauuucuaagucacuguauccuagaacaaacucaacaguauuuauaggaauauaaaaauaucuggcauccaacaagguaaaauucacaauaucugccauccaauaaaugaauacuaugaauaaaugaauacauauauaaauaugguccauaaugagggaagaaaugaagcaaucaaaaccacugacccagaacugauauagaccuuagaauuagcaauuacauuaaaauaguuauuauaacuguauuuuuuauguacaaaaguuaaaucaagacauggcagauuuuguaaaagaccaaaaugaaacuuuaggaaaugaaaucuauaauaucucagaugaaauaauauacuagaugaaauuagugacagacuguagaagaaaagaugagugaacaugaagacauaggaaugaauagagaauagugagcugugggacaacuucagauggccuaauauagauauaauuggaguucccagaagagaggagggacgaaaaacauacagaaauaaugaucaaauguuuucaaauuuaucuauuauuauuauuuuuauuuauuuauuuauuuauuuauuuugagacagagucucgcucugucgcccaggcuggagugcaguggcacgaucuccgcucaaugcaagcuccaccucccggguuuacgccauucucuugcuucagccuuccgaguagcugggacuacaggcaccugccaccaugccuaaguuuuuguauuuuuaguagagacgggguuucaucguguuagccagauggucucgaucuccugaccucaugauccgcccgccuuggccucccaaagugcugggauuacaggcaugagccaccgugcccggccuauuauuuuuauuuuugagacaaggucuugcucugucacccaggcuggagugcaguggugcaaucucagcucucugcauacuccaccugcuggguucaagcgauucucgugcuucagcuucccaaguagcugggauuacaggcguguaccaccaagccuggcuaauuuuuguauuuuuaguagagaugggguuucaccauguuggccaggcuggucucgaacuccuggccucaagugauccaccugccucggcuucccaaaguguugggacuauaggcgugagccacugcacucagcuuuuucaaauuuaaugaaaaccaugaauccagauaucugaaagcucagcaaacccugaguauaagaaacaugaagaaaacuacauuaaggcacaugauaauuguauugcucaaaaccgauaauaaagaaauguuaaaugaaacaagaaggaaaaaaggcagaguaucuacagaggcacaaaguuaaggaugacagcagaccuucuguuggaaacagugcagucaagaagauagcgaaccaacaucuuuaaagugcccaaagaaaaacaucacagacuuugaauucuauagccagagaaaauauccuucaaaaaugaagguaaugugaagauuuccagucauacagaaaacuugaaagaaccccgcccccuuagaccuacccaacaagaaaugugaagggaaguucuucggguggaaagacaggccaggugaagauaagaauccacauaaaagaaugaagauccggaaauggggaucuaagugacccuggcacaaacuaacaauaucuuuuaagaugaacaaaaaagacuacucaucugagacucaggccauggacacucaagugagugaccuauaacacuucacagaacauacaaucagacaucaggaacuggucauguaggcuuuuuuauaguucuaaacuaaauacuacauagaacuuugugacugcccuguuuauuuagcuuuagaacuucaugugcuaguucagucugugaagauucauuauugaucagauauauacaaucuguaauuuggaauauucauucauauuuaguugaacuuuaacaagucacaaguuguucuccauagcaaaccguaaaagaauaaaauuaaaguuaaagagaggucuguccgucagcauauuaagguuugucuguuuuguuugccucauuaauauuuuguuucccuuuuuucugaugugaucguuuuccuccaauuuagauacgucugcaauuuauucuucagucucauuuacauucaugacccaugauccucaaaaccuauaccuucucuaaaaccuuaucuggaaccauggccucccuccacuguggacgaggcaucauucuguaccauacgccaguuccugguuguuuccucuggcaucuucuuuuguagcuccuuuaauccuucagacugcuuagauccuaugaucugcccccauaacacuuacuaauuuuaucuugcauuuuuuuacauuggcaaguauucguuuacuuacucaugcauauuugccaaaagucugcauuuccauucaacaggaaucucauugguaacagagauuacuuaaccauuaauauugaugaucaacuggcuggcuguuuaaauugccacuuuccuauugaauuuugaagggugcccauggugaaucuugugugucccucaugcuuggcacacaguggauacuuacucacucuuguugauguuugccagccaccuuggcccagaauuucugcuugggaaauaguaucacggaugcauuugucagaugaaaagccugcuucuggcuuuauaauggacccuuuauccucauugucuuuaggggacuccugguccuagaguaguuaaauaguaagaauugaaugauuuuuuuaaguugcagugauuacagcaaaaaaaaaaaaauugccaaguaauguuuuauuuaauaagaaagaaacauuuucugaauaccuaaaaaagaagcugccaaucagcuuuuaaagugauuaaaaauaagaaaaaaugcccuauauguacacauauuuuuaucacuuucagcacucuccauguauuuaauuccaaguuuuagguccaaguuuucauuugauaccauauuccuucugccugaagaauuucuuuaaccucuuggagugcaggucugcuggcuguaaguccucucagcuuuugucugcagucuuuugacuucauuuucccaagguauuuucacuggcuauagaauucuggaugggcucaaguuuguuucccuuaaagcugucacucauuaucuuccacuugcaugccuucugacauacauuuuaucuuugauguauuauauguaauuuuuuucauggcauccuuuaauguuuucccuuuaucuuuuaaacagcuacaauacauuuagaagcguguguguguguuucuuuuuugguauuuacucugcuuuggguuucacugagcuuagugaaucuaugguuugcuaucuuucauuauuauugcaaaauuaucuacuauuuuuuuuaaaacacuuuguccuuuuggcugggcgcgguggcucacgccuguaaucccagcacuuugggaggccgaggcgggcggaucacgaggccaggagaucgagaccauacuggcuaacauggugaaacuccgucucuaccaaaaauacaaaaaaagaaauuagccaggcgugguggcgggcgccuguagucccagcuacucgggaggcugaggcaggaggauggcgugaauccgggaggcggagcuugcagugagccgacaucgcgccacugcacuccagccugggcgacagagugagacuccgucucaaaaaaaaaaaaaaaaaaaaaaaaaaaaaaaaaaaaaaacacuuuguccuuuuaucugucucuucuguuuuugagacuccaauuauacauauuuuagauuauuugguguugugccacagcucuuuaauucuucaguuuuucucacuuguuuuuucucuuuguauuuuaguucagguaacuucuauuuaccuauuuucaaaugcacagauuuuuuuuuuucuucaccuguguccaucugagcuguguauuguugagcucaucaaacauucuucaucuuuaauagcauguuuucccuuucucacauuccugucugacuucauuuuucugcugagacucuccaucuguguauucuguuaccaccuucaccaguugccuuccccuuuuaaucacaguucugugaaaggcccuccugacagcuucagcacaagugcugucugacacuuggccucuugauugccugcccucuuggcagugagugauuauuccuugcuuuuuaaugggucucauaaguuuauuuggauguuguacaucauguuaagaauagcagagauugucacaaugagauaucaaccucaccccaauuaaaauggccauuaucaaaaagaaaacaaaugcuggggaggguauggagaaaggggaacccuagcacacugcugguggaaauguaaauuggcacagcuacuauggagaacaguguggaggucccucaaaaaacuaaaaucagaacuaccauaugaucuugcaaucccacuauuugguauauauccaaaaggaaaucaguauauugaaggccuguucauuccccuguguuuaagcacuauucauaauggccaagauguggaaucaaccguguccaucagcaggugaauggauaaagaaaaugugguccauacaguggaauauuacucaaccagaaaauuaaugaaauccuguuauuuucagcaacgugaauggaacuggaguucauuaauguuaagugaaauaagccagucauagacaaauauuacauguucucaaucauacgugggagcuaaaaagguugauuucauagaggugguaaguagaauaacauaccagagguuagaaaggagggagggagguuggaugaagauggauggaugaagagagguugauuaaggggcacaaaaauacaauuacuaauagaaggaauaaguucuaguauuugauaguacaguagggaaauuauaguuaguaauuuauuguguauuucaaaguagcuagucuuuaagagaagaauuguaauauucccaacacaaagauacagccugggcaacauggugaaaccacaucucuacaaaaaaauacaaaaauuagcugggcaugguggugcacaucuguggucccagcugcuggggaggcugaggugggaggauugcuugagcccaggaggcggagguugcagugagccaagaucaugccacugcacucuagcccaagcgacagaacaaggcccugccucuucuuccccacccaaagaaaaacaaaagauaaauauuugaggugauggcuaucccaguuacucugauuuguucauuuuacaucguauacaugcauaagauaucacauguaccccccaaaauauguacaacuauuauacaucaguuuuaaaaagaacaacagacauugaaauaaagacauacuccugaaaaugggcauaccuccucuuaggcuguugauaggcaggagguguucagucuaguacgagucgauuuggguuaggguuuuguucaguguuugggccugugccuucaaugccucacaaguuucaaauuccuucagugaugggcugcuguucauuugcuucgaguugggguuuaggugcagaaggaaggguuuuucucugaguuccuaccuccccuguagcuuucagcucuuaccacgucauugcaccucugugggagucacugucuauguucuuguuccucccacagaggucaucugcuguugcguguuauucacauuagaggacaguuggaaagugaggggggcgugccuguuguccuuagguagguucuguguugcuagaccuuaagggugcagcuuccucagggcucuugcaccuccucccacagagguagcugacugcccugugguccuccuguaggauccuaugcccacaaggagagaggaaggugucaucuucuccucuuccucagcaucagaggaucuuagccuggucagagcacagggagcauuuccucuacauccccaagaggcagagggacuuugcugcuucuccucccuccaaaguaauggaucuuugccugugcucuggggcagggggaagagggugugcaagaaagaaaacaacagucauguuauacagcgagggccuuguguagauagaguuuauguagucauaauaaugcaagcacugaauguugagcuaaacaaauaauauaacuguaaggaggaugugaggauggaaguauuucuguuuugggaagccgcaggguguuaaaugaucaguuaaauugucauauuccccaguguaaggucaauaguuaaagccuaagacugaaaaacuuaaaaugucaauguaaggaugcuauuuagaaauaaugagggccagcugugguggcucacaccuguaaucccagcaauuugggaggcugagguggguggaucacuugaggccagaaguucgagaccagcguggccaacuagcggaaccuuaacucuacuaaaaauacaaaaauuagccugguaugguggugugugccugcagucccagcuacuugggguucccaagaauugaucaaaccaggaaggcggggguugcagugagcugagaucacaccacuguacucuagccugggcgacaagagugagacccuaucucaaaaaaaaaaaagaaaaaaaagaaaaaagaauuagguaaauauuaaauaagcuucaaaaagucacaauucuuuauucuaagaaguggaaacuggauaggaggaggagaggagacaaaguauggcuuuuucauuaccaagccauggagaacuguaugacauucaaagguaggcgaauaaagaugcuugauaaaauuaaauauuaaguucuauaaauauaaaauuugauacauuuaaaacugaauucuaaaaguuuauaacacaaggguagggauaaagguguagggaaaauaggcauucucauauguugguggagggauuccaacugguucacccuuuaaggaggucaguagggcacuccaucaaaguuccaaauucaguaauuccuacuacagauaugguagaaaauuguauuucacacuugaaugcaauaagacuagaaaccauccaaauauuaccaguagguggccgggcgcaguggcacacaucuguaaucccagcacuuugggaggcugaagcagguggaucauuugagguuaggaguucaagaccagccuggccaacauggugaaaccccaucucuacuaaaaaaaaauacaaaaauuagccaggugugguggugggugccuguaaucccagcuacucgggaggcugaggcagggaggauugcuuaaacccgggaggcaaagcuugcagugagcugagauugcgccauugcacuccagccuggaggacagaguaagacuccaucucaaaauaaauaaagaaaaauaaaaauaaagauuaccaauaggugaaugguuagcagcuauacaguggaauacuaucuagccauuaaagaaaaaggugacacuuuguguacuuacguggaaugauaccccagguaagaagcaagaugcagaacggcaucagugucucuccagauuaccagagaaaccagaaguaguuuuguuucuaaggaaacagggaaauaauucucuucuaaggaagugaacuugauagcuuagggauagagcugggaggaggauuuuuuuuugccauauacccuuuugugucuuuuggauuuuaaacuauuugagucaauuacccauauaaaguuuuaaaaauaaaauuauaaugguuaaguacauugggcuauuuauauggaaaauacuuuaauuuguuucuuaguuuccauuauauauuauacauucugaauggaccauaugacuaaaugagagaaucaauauguuaaaaccaggccaggcacagugggucacaccuguaaucucagcaguuugggaggccaaagcaggaggauugcuuugaacccaggcuggucucaucucgaacuccuguggucaaaucaacuuccuaucccaggaguuugagaccagccuaggcaacauggugaaaccucaucucuaugaaaaauacaaaaauuagccaggcguaguggaacauaccaguagucccagccacuugggaggcugaggugggaggaucacuuaagcccaggagguugaagcuucagugagcugagaucgugccacuacacucuagccugggugacagagugagacccugucucaaaaaaaaaaaaaaaaaaaaaauuaaaccuugagaacauauuucuugacauuaggauuggaagguugucuuaagagacaaaagcaugucaaaaagaguaaagaugaaguaauuugucuacacuaaaauuuaaaaacugacauaaaaaugccauaaagagaaugcugugauaaucauggacugagaagauuguugaaacacaauugucaacauuugguauacagauuauauaaugaacgccuacaaaucaaugaggagaagaguucagggaacacuucaauugaauaaugugcaauaaacacaaauagauugaucaggcauagugucucacgccuguaaucccagcacuuugggaggccaacauggcagaucgcuugagcucaggaguucgagaccauccugggcaacauagcaaaaccccaucucuacuaaaaauacaaaaaaagauuagcugggcaugguggcacguaccuguagucccagcuacucaggaggcugaggugggaggaucgcuugagccuggguggcagagguugcagugaacugagaucguaccacugcauuccagccugggcaacagagcuagauucuaucucaaaaaauaaguauuuguuaaaaauaugaguaggcaguucacagaaaaaaaaaagcugaacuguggaaaaaaauucaauuuugcuaguaaccagaggaaagcauauuaaaagaaggcauuguuucauaucuaucaaguuggcaaaagucugaaaauaugacuucgagguuuggguuggaauguaaggaaauguauauugugauuauuugaagucguauuuuuuuauagcuaggaugacacuucacaucugauuuugauagugucuuuuuacaugccaauacacuauagacaucuuucuguuuuaacaugauacauagaacucugaacuccauuucuagauguauuuaacaggauauauuauccaaugauaagacuaauuuggauaggauucuuucugagggaaggauaaugguauagagaaccucaagguuuuucuuaggguuuuauaguuuuucauuuuuaauguagauuguuuucugcuuuuuuaaaagacauuauugcaagagcaucucaagcagacgucguuacaaucgugauuuggaacaggaugaagcauuuauuccaguuggagaaucacuaaaagaccuuauugaccagucacaaaguucugguagugggucuggacuaccuuuauugguaaguuaaacguuccuauagacaugaaugguguguugauuuagaauguguccucaugaugguggacaguauaauuauugcagaucagggaacaauaauggacacauuuuuuucuccuuauuuagaaagagguaugcaguauugcaaggugaaauuaguuaaaaauaagaaauaugaaccaagaaaaauagaauagucaaguaagauagagcuauaaaccagguuauaggaaccaaguccuacagagaaaggcaggggaaguuagaucacgaaguccuauaugaaaggcaagaguuagcucacaaguuuugcucuaagcauuuuaccagccaacuuaaagaggaaucagguauaagauuccuugcaucuguaaguuuaaacugauugauugagggaacuguaacuauuucagauucugaaauaaaaaagaaguuucaacagauauucuuagagaggaugcuucucucaauauacuacuaccaaaacacauaguucaauaaaaaauaauuuuaaagggaauuacaaauaaauuccaacaaauuuggauggauucuugguaucagggaaaaaaaaauaaucccagcagguucauuuauauauggaaauacucaguuuuggguugaaggaacucuuauuugagaggaccuguauuaugaacacuagauauccagauagguuuaaguuuuuaauuguauuaguugaaagaaacugaucucuucuuauuuuauuuuauuuuacuuuauuuuauuuuaaucguaucgagauagucuugcucugucacccaggcuggagugcaguggcccagucuucggcucacugcaaccccugcuucccaaguucaagcaauucccgucucagccuccgaaguagcuggaauuaccagaugcaccaccacaccaggcuaauuuuuuuuuuuuuuuuuuuuugagggaugagguuucuccauguuggccaggcuggucucaaacuccuggccucaacugauccuuccaccuuggcuccuaaagugcugggauuacaggugugaaccaccgcacccacccugaucucuaauuuugaaauucaucuuauuaaauaacucuaauugaauuggaaagguaaaaguaaaacugccuucauaggcagacaacaugauuguuuacguagaaaaucccaagaaugguacaauaaaacuacugcagccaguaaaugacuuuaucagguugcagaauacagagucauuguacaaauaccauugaauuuauaggcucuagcaacaaacaauuagguaauuauaaaaacaguauuuaaaauagcaucaaaaaccaugaaauauuuagaauaagccuaacaauuuaugcaagaccugcacacugaaaauuauaaaacauugcugaaagaaauuaauaaagcccuaaauaaguggagauguuuauaaaucugaggacucaguauuaagauuucaguuuuccucaaauugguguguaauuucauucgaauccaaaugaaaaucagagcaaacuuuuauagcaauugauguauauucuaacauuuauauggaaaugcaaaggacuagaagagccaaaacaauuuugaaguagaagaacaaagaggaaucacuaccugauuucuggacuuaccguaaaacucaauaaugaucucaauuugguacuggcauaaggauagauguauugaugaauggaacagauuauggaguuuagaaaggaacaugcacuuaauaugguuaauugauuaaaaaaaaaaaaacaaaaagaugcccaaguaauucaauuggaaaaaggcaguccauuuaacagauggugcaggaaauaucaggaauccauuuaccaagaaguuaaucucaguccuuaccuccucacucuauaccaaauuaacuugaaauguagcauagaccuaaauguaaaaguugaaguauaaaaccucuaaaagaaaaugucugaaaaaauuauucugaccuugggcagacuucuucaguacauaaaaaacacaaaucauuuuuuuaaugauaaaucaggcuuuaucaaaauuuaaaacuucugcuauuuagaagacaagaaaaugagaagacaagucacagauuggcaaaacagaucugauacaggguuuuugugcaaaauauauaaagaccuuuugcaacucaauaauaagauaacccaauuuuuuuaaaaaauggacaaaagauuugaacagacacuuccccaaagaagauauaagaauggcaaacaagcacaugaaaagaugcucagcaucagcagggauauacaaauuaaacacaguaagauacuacugcacauccacuaguauagcuaagacugauaauauuaaguggugccaaagauguagaucaacuagaaaucucauacauugcugguuggaaugcaaaaugguauggcuauuuugaaaaauaguuugacaauugccuggaaaguuaagggcauacuuuccguacaaugaagcaauccuucugcuaauuauuuacccaagagauaugaaaacuuguccacaccagaggccugaaugugaauguuuauagcaguuuuauuuauaauagacauaaacuggaaacaaccccaaagcucaugaauugcuaaaugaauaaacaaaugcugguacauucauacaguggaauauuacucaucaguaaaaaggaacaacuucuaacacauguagcagcaacagugggugaauuucaaaaguacuuuaugcuacaugaaagaagccagacacaaaaggcuacacaaaagugauucuccugccucagccucccaaguagcugggauuaaggcaugcaccaccaugcccagcuaauuuuuguauuuuuuuuuaaguagagacaggguuucaccauguuggccaggcuggucuugaacuccugaccucaggugauccacccgccucggccucccaaaguguugggauuacaggcgugagccaccacgccuggccaaaaagugagaauuuuuuuacguuauuaaaauauucuguaucuuaauugugguauuggugauuacaugauauagauuuguccaaggcuuguugaacuuuucucaaaaaggguacauuuuauauaaauuauaccucaauaaucuugacuuaaaaacuuacaggcugaggcaggcagaucacuugaggucagguguucgagaccagucuggccaacauggugaaacccugucucuacuaaaaauacaaaaauuagcuggacgugguggcagaugccuguaaucccagcugcucgggaggcugaggcaggaaauuguuuuaacuggggaggcagaaguugcagugagcugagauuggccgccgcacuccagccugagcaacggagcgagacucugucucaaaaaaacagaacaaaauuuacaaaaggauucuauaauaaaugauacauaaagucacuuuagcuuugcacuaaaucuaguccauuuuagaagcauuuccaacuuggagcauaauguucuuuuuaauuuagaaugaucacuaaugcuucugaaaaugaaagauaacaauccauguacaucuuuuauuuaacaaauauuaaaguacuucugauauugucccaaauaaauacuuauauucugugagcaggggauggaauucaagcaaauauauauguaaauaagaauaaaguuaugauuguguuaagcgcagcaacugagagguuuugugugcuaugaagguguuuaagugagaaaauagcacucuaaguaaagggaacuggauauucaaaaaaacccagcgacaggaauaagcuugagugaauucuaaaaguugagauaagucaaacgagguuuguggguggguggucaaagcaaauaaugggaccaggccagaucaggcagggucuuauagaugggauuuuuaagaucuuuaacuguuauuuggacuuugcugcauaauaaaccaccccaaaacuuagugaugugaagcaacaaacauuauuucucauucugugagucuguggggcaguucauuuguuggacuugcuuagcuagagcuaggugguguaguucacacccuuggccgacaguucaugcugccauuauuuuuuggucacaggguucccaaagcagcaggaagggggcaagccccaguccacaaacauuugucaggucuuugcuugcaucacguucgcuguuguucuuuuauccaaagcaagucauguggccuaagcccugagucuguggaccaagacuacccacgacugugugcacugggaggguaauuauuaugaccauuuuugcaaacagccagccacuugaauaaccuguuuaugauuucagaauacauuguacauuguuucauacuuuaaaguacauuauggccgggcaugguggcucacgccuguaaucccagcauuaugggaggccgggggugggguggaucaccugaggucaggaguucaagaccagccuggucaacguggcuaaaccccaucucuacuaaaaauacaaaaaaauuagcugggcaugguggcgggugucuguaaucccagcuacuugggaggcugaggcaggagaaucacuugaaucuaaaaggugaagguugcagugagccgagaucgcgccacugcacuccauccugggugacagagcgagacuccaucucaaaaaaaaaaaaguacauuauaaguuuuuaacuggaguugguuggguacaccaugcuuuuugaugagauggacuaccccuuugccagucuuaauggguuucuuucaucaagagcucaaaccuuuuacuuuuuucuauaaagguucagcgaacuauugccaaacagauucagaugguccggcaaguugguaaaggccgauauggagaaguauggaugggcaaauggcguggcgaaaaaguggcggugaaaguauucuuuaccacugaagaagccagcugguuucgagaaacagaaaucuaccaaacugugcuaaugcgccaugaaaacauacuugguggguacacacugauucagucaauuucauuuuugacaaggcuagugagguacagguggaagccuccauaugugcuuugaaaaugugugaguucaacuauauacauuuggcuaaaggaaaccuaguagaauacacgguuugaauaaaacauaguccggaaugccaaccaagaucuuucuuuacuaaccagcugaagaaacagcagugaguuucaaauggaaaauaauacuaguuuauuggacuuacucccauaguaaugaaaacccagucuuuuauagauaacuuaagcagugauuuaggguaacauuaacauaugugccuuuucccuuucauaagcucaacagcccaacaugcaguuucauuguacguucuguguuuaauguguguuuccccccaucuccacauuuacacaauagcaaaguaauuuaggugugagcuggucagucagguacauaagccgaucuggcuauccugaguuuucuuuucccuucaccucuuguuuuccucccuuuaauuuggagagcccauagcauguugccaagcaggcaauuguauuaguuuccuagggcugcuguaucaauuaccacaaacuggguggcuucaaccuccaaaacguauucacucaguuuucgaggcuagaaguuuaaaaccaagguguuggcagagcuguugugucucugaauacucuagaggaggagccuuccuugccuccucuggcuacugguugguggccaggaauuuuugguguuccuuggcuuaguauagacaacacucuagucuccauuucugucaucagguggccuucucccugggugccuggguccacauuuccaccuuacaacaucaccagccauugaauucgggcccacgcuaauccuguaugagucaucuuaacuugauuacaucugcaaagacccucuuuccaaauaaggucacguuuauagaugacauggauuuuagacaugaauuuugucggggagcacuguucagcucaguacauagcacucacugaccuuuuucuggagggaagaggguaggagagaaaggaaaagagcaggacugugggccuggcagucaacgagccagacugaaaaggcagcugugaugagucacugaugggcaaaugggaguuggcuuaauuaggagcuaacucuuaguugaacauucuuaauuuuauaaaaguguccacuuuuugcuuugaaauugagagccuuuucuacuagagaaucauguagguugauaauauucuccagguuauuuguauaauaugucaucuuuuucuuuucuuuccuuuucuuuucuuuuuuuuuuuuuugagacggagucucauucugucgcucaggcuggagugcaguggcgccaucuuggcucacugcaaccucugccgccagguucaagugauucucuugccucagccuccagaguagccgggaccacaggcacuugccaccaugcccaacuaauuuuuguauuuuuaguagagacgggguuucgcccuguuggccaggcuggucucgagcuccugaccucaagugauccuccugccuuggccucccaaagugauacaggugugagccaccacacccagcauauaugaucuuuuucuuaauccuauucacuuucaugauuauuaagauuauuauaaauuuauuguagaaguacagauauauguguaaauguagaaauauaauuuuuaguaacacauucacgacuuggugucaggcgaauuaaaguuucacuaucugcacaugauaccuaaguuuuucucaguauccagaaugagcauuacuucucccuagccuaucucugaugauaacuaaccuuuuaaacucaucaacuggacagguuucauagcggcagacauuaaagguacagguuccuggacucagcucuauuugauuacugauuaccaugaaaauggaucucucuaugacuuccugaaaugugcuacacuggacaccagagcccugcuuaaauuggcuuauucagcugccuguggucugugccaccugcacacagaaauuuauggcacccaaggaaagcccgcaauugcucaucgagaccuaaagagcaaaaacauccucaucaagaaaaaugggaguugcugcauugcugaccugggccuugcuguuaaauucaacaggugagugguucuuugccccacuguuuugaaauuauuuuaauuuccaaaagauauuucccuauuuguauucaagauaauggaauucuaaaaaugugcauaugcuuguuuuuaguuacauaaauguauaguugggggggauuuuguucuuuuuacaaaaauuguguccuacuucuccuauacauaauucuugauauauauauauuuuuuugguguuuuuuuuuguuuguuuuuuguuuuuuguuuuuuguuuuuuuuaaagacagugucucacucaguugcccaggcuggaauauaguagugugaucuuagcucacugcaaccucgaccucaugggcucaagcaauccucccaccucagccuccugaguagcugggacuacaggcaugcacugccacaccuagcuaauguuuuuauuuuuugcggagauggggucucacuguguugccuaggcuggucucaaacuccuaggcucagcugauccucccaaagugcugggauuacaggugugugccauauagucuuagccauccuuccauuucagcugauguaaaucuacuucauucuuuuuaacagaugcagaguuuuccauauguggagguacuguaguuuauucuuaagacccaacugaugaacauuaaaggugucuucaguugauuaugaaaagguuuuuuaaugaacauuguuguauuuuaaccauauauuauauauuugauccuugugcacuuguacaagcauuucuucaugauggauuccuagagaagggccugcugaggcagugaguuuauacauauuaaacuaugguauguugcauauuauuucuuucagcagugugccucaguuuacacacccguaagcaguagagauaaggaugucauuuuucugucaccacuugauagugucaguauuuuaaaacaaaugcaaguguuagaaauuacaaauuuuuaggaaaccuuugaaaccauuuuaaucuuguaauucuagaauggaguggcugcuuuacauuucagaauucauuuuaggcuguaauauaaaaguaccagucuuuaaaacaacuguaagagacauuuaaaucuguuacaguguucugagucaguguaguauuuguuggcucagauauuuaucagaugcuauaggaaaauacaacgcauuauauugaucacugcuuuagaguaauuauuacuaauugucaguaugaucauguaaacauugcuaacaacagaacucuguugaugggacccauaaagaagaaaauguaauccuaugucacaaagccuuaguguaucauaugagagugguaaaagcaagcgauuccucuuguauuuucauauucaccacuucucagacauaauuaucuacuacuuuaucuuuuuuuuuuccuuuucuuuucuuuuuuuuuuuuuuuuugagagagauucucacucuguugcccaggcuggagugcaguggcauggucucggcucacugcagucuccgccucccagguucaaguaauuuucgugcuucagccucccaaguagcuggaauuauagucaugugccaccaacccugguuaacuuuuguauuuuauagagacaguguuuuaccauguuggccaggcugaucuugaacaccugaccucaggugaugcgcccgccuuggccucccaaagugcugagauuacaggcaugagcaaccgugccuggcuuaacuuuaucuuauauucaguguuguccucuuucuuagacaccagacuuauuuagugacaaaaccugaccugaacggaugugagguguguauugcccuuauccaguugaggaggacuaucggacuuaguguuuugcuguagacacaguacugaguacugaguuggauuaagagugcugccccaacccugcugaggaugucauguaguauguagcauguauuuaaagaaaaaucugaaaaaugcuaaauuccacaaugcaucuggccccaaggagaaaaagaagcuuuuauaaaauaggacaaaaauacaagauaaacuauuuuauuuuuggcccucaacuuggaccuuggcuuucuuuuguuucagugacacaaaugaaguugaugugcccuugaauaccagggugggcaccaaacgcuacauggcucccgaagugcuggacgaaagccugaacaaaaaccacuuccagcccuacaucauggcugacaucuacagcuucggccuaaucauuugggagauggcucgucguuguaucacaggaggugggaguuugaguaguuucugauuauguugauuuacucaucauuuuaaaaauaacagcuccaguuauauaacuuuuuaguuuuuaauuuuugugggcacauaguagguguauauauuauuggauaaggaguuauuuugauacaggcaugccauguguaauaaucacaucuuggagaauuggauaucugucccuucagacauuuauccuuuguuucaccaaccaguuauacuccuugaguuauuuuuaaguguacaauuaaauuauuacuaacuguaguccuccccguugugcuauaaaauaccaaauacuuauucauucuucuauuuugucucuacuuauuaaacauccccccccaucugcugcuacccuucccaaccucugguaaccauccuucuguucuccaugaguucaguuguuuugauuuuuagaucucacaaguaagugagaacaugugaaguuugucuuucugugccuggcuuauuuuacuuaacguuaugacauccaguuccuccauguuauuucagaaggcagaaucucauucuuuuuucuggcugaaugauacuccauuguguguaggugccacauuuucuugauguguucaucuguugauggucacuuagguugcuuccacaucuuggcuauugugaacagugcugcagcaaacaugagggugcagguaucucuucgguuagcugauuuccuuucuuuuggguauacaccuaggagugcaauugcuggcaguuacguaauuuagaugucacauacgucagaguccccaagaccacccccagguugugcgauuucacuugaaggaccacaggacucggcaugugguugucccaauggcuaacauuuaucccagugaaaggauacaaaucaaaaucagccaaguuuagaaaaccaggcgaggcuucccagaauccugucccagcggagucagggcgugugcuucauuccucuuacuaguugugacaacacauacaaaguguucucauucgggaaagcuccuuagagacuuggcacccagagauuuuacuggaggcuggucacauaggcauccucugccuggcauguaccagaauuccagcaggaaagcagacgugcaguacacaccacauuguuugcacaagcagcccaggaguggugaguuacccucaccguuuccgguaaguuuuauauccauguagggaacuguuuaccauuuguguacccgggcacuggccaaggccaaaccuugcaagccgccuuuccuaagggaaggucucaggccugcugugugaacccuuaucugcaccucauaagucuuucuacugcagagcaaaaugaaacaaaauaauaaaaacuauucauuaguaggaacaaccauauaaguaaauaauuauacuuuaggguaaauggcugauuucgccuugcuuauuuuuuuuaaggaagauugauaugcccuuugucgauggacucuaucacaguugugaugacaucccugguggagguagaggaaauaguuggacauaaauaagagaaaaacauacaucuacuauuaagagugaaucauagugucuauauuuuuucuuguguaagaauccguuuuaguuccauaguuuagcaaaagaugcuuacuagauugguauaucuuguccagcaaccauuuuugugcccauguuuucucauucccuuauagggaucguggaagaauaccaauugccauauuacaacaugguaccgagugauccgucauacgaagauaugcgugagguugugugugucaaacguuugcggccaauugugucuaaucgguggaacagugaugaagugaguggaacucaguccccugaagaagugauucguaaaugccaccaaauauauucucugcucacugaacaucucuuuacuuuucagugucuacgagcaguuuugaagcuaaugucagaaugcugggcccacaauccagccuccagacucacagcauugagaauuaagaagacgcuugccaagaugguugaaucccaagauguaaaaaucugaugguuaaaccaucggaggagaaacucuagacugcaagaacuguuuuuacccauggcauggguggaauuagaguggaauaaggauguuaacuugguucucagacucuuucuucacuacguguucacaggcugcuaauauuaaaccuuucaguacucuuauuaggauacaagcugggaacuucuaaacacuucauucuuuauauauggacagcuuuauuuuaaaugugguuuuugaugccuuuuuuuaaguggguuuuuaugaacugcaucaagacuucaauccugauuagugucuccagucaagcucuggguacugaauugccuguucauaaaacggugcuuucugugaaagccuuaagaagauaaaugagcgcagcagagauggagaaauagacuuugccuuuuaccugagacuuucaguucguuuguauucuaccuuuguaaaacagccuauagaugaugauguguuugggauacugcuuauuuuaugauaguuuguccuguguccuuagugaugugugugugucuccaugcacaugcacgccgggauuccucugcugccauuugaauuagaagaaaauaauuuauaugcaugcacaggaagauauugguggccggugguuuugugcuuuaaaaaugcaauaucugaccaagauucgccaaucucauacaagccauuuacuuugcaagugagauagcuuccccaccagcuuuauuuuuuaacaugaaagcugaugccaaggccaaaagaaguuuaaagcaucuguaaauuuggacuguuuuccuucaaccaccauuuuuuuugugguuauuauuuuugucacggaaagcauccucuccaaaguuggagcuucuauugccaugaaccaugcuuacaaagaaagcacuucuuauugaagugaauuccugcauuugauagcaauguaagugccuauaaccauguucuauauucuuuauucucaguaacuuuuaaaagggaaguuauuuauauuuuguguauaaugugcuuuauuugcaaaucacccacuccuuuacaaccauacuuuauauauguacauacauucauacuguagaaaccagcucauguguaccucauaucccauccuuaagagaagaaauguuauaaaguagaacuaaauauaaauuuucagaauuaaugcauucaaaguaauauaucaaauccaggacuuuguuaacuucagguaaaaacuucauuaggguaauaucaucucaauuuuuucaaaugaaaggauucucuaauuagaaauuuauaugucagagcuguuauaaauuuaucaacugucaaauauguucuggacagcuaaaucauuugagauuuuugguuuuuugauuucuauucccuaacuugugaagacaaugaaaaaucaggcagaaauauuuaguaucuagucaguaucuguagcuacacuguauaacuguucuucaauaaaaugguucauauuuuauaga

SEQ ID NO: 193039 - RNA, 30970 nt, Homo sapiens
cgccucuacgcgcgcccgccguucccgcgaggcccaccuagagccgggcggcgcaggcgcagaguccccgggccaagauggcugcgcggugcuccacacgcugguugcuggugguuguggggaccccgcggcugccggcuauaucggguagaggggcccggccgcccagggagggcguggugggggcauggcugagccgcaagcugagcguccccgccuuugcgucuucccugaccucuugcggcccccgagcgcugcugacauugagaccuggugucagccuuacaggugagggcagguuccaacuuccgaguggcgguuucagggccuagaaaagagugagucuccucgcugugacuacggcugcagggguagugggguggagggugucuuccgacgcggaugcacaauugccggagacacagacaggcaggaggcggggaggccccaguggcugcucagccgucaaggaagggagagaagcguggagcccccggcggcggugaugaaacgccccguagaucgugaaccuucaccucucugucaacauuucuggaggccgcugcucccucguccucuuccuuucccaucucuccaccuucuagcccguagcggaagggaagagcuaacugccauucggagaggccuagguacuuuguuacaacaacccugcaagaugccugccgucaucaccauuuuaaagaaugagaaacugagauucaacggaggaaucgaccagcccaaggucauggaguuagacuagaagaguugucucaaacccaaagcagucaugucauaguuuacgcucuuucuaccacguggugcuaauugaagggcacaguuaacaaucuuuuuagaagucuuuaguuggugauuguaauaauaacacagucagacauuuauugagcacuuacuguuggccaggcaugguuuuccccuuacaucacauuuccacaugauaggcacuguuauuccauuuuauaaagauacugaggcuuagauguuaaaccacuuauaaaugucacaaggagguggaggcuugauaucauugccugagaugacacugaauuauacauuaagccuugaagugcuuagucauguuuucuuuucuuuucuuuucuuuuuuuuuuugaaacugaaucuugcucuguugcccaggccggagugcaguggcucaaucucgacucacugcaaccuccgacuccuggguucaagagauuauccugccucagccuccccaguagcuggaacuagaggcaugcgccaccacgccuggccaauuuuuguaucuuuaauagagacgggauuucgccauguuggccaggcuggucucaaacuccagaccucaggugauccgccuccccuuggcuucccaaagugcugggauuacaggcgugaaccaccgugcccugcuuagccuucuuuucuuaugccguguguuuugugcuguguguuguacguaccugaauugugcuaguuuuguguccucuagaauuugugcaaaugguauuuaagcuaucuauaaauuuauaaagauuaauuaaagggcccugacaagauaauuuauaccaacuaacuuccuguugcaauccaguuuguaauaguuacauaguagacaaucauuaaaguaucaguaauugugguuacuucaugcaauguaaagaaaagagccugggcuucaggggugaacuuccccagcgucugugagcgggguguauuauuuaaccccuucgagcaccugucugaaaauucauucauucacagguguuaauugaggccaauuguaugccagccacuguucugggcacugaggagauggcagagaacaaagagauuggauguguguuugguuaagagaaugauuauuuauguauuuaauuauuuuuuaagacagggccuccuguugcccagacuggugcagaggcacaauuacaacucagugcaaccuugaccucccagguucaaucgauccuccauccucagccuccugaguagcugggacuacaggcaugcaccaccacacccagcuaguuuucuguagaugggguuucaccauguuacccaggcugggcuaaagugauucccuugcuucagcuucccaaagugcugggguuacaggcaucagccacugcaccuggccaacagaaugaauuuuuuuuuuuuuugagacggagucucgcuguguugcccaggcuggagugcaguggcgcuaucucagcucacugcaagcuccgccucccggguucacgccauucuccugccucagccuucugaguagcugggacuacaggcgcccgccaccacgcccagcuaauuuuuuguauuuuuaguagagacaggguuucaccguguuagccaagauggucucgaucuccugaacuugugauccacccgccucagccucccaaagugcuggaauuacaggcuugagccaccgcgaccggccuuauuuuuauuuugagauggacucuugcucuguugcccaggccaaauugcagugaugugauccuggcucacuucagccucccaagaugcugggcuuauaggugugugccaccaugccaggcuagauuuuucaacaugagcaaaaguggccauuuuuagagcuugcuaacauuuucuaaugucaagguuguuuuaaauagaaucuggcugcaucuuuucauucaaauauuaauccuuaggugacuuguuuuauuaagccaaauuuguucauguuccagcuguacaaauuugggagcacucguuauuauuguguaugugaaagagagaaacaggcacuaaacacuaagcuuugugugaagcugugacuaaggaacugcgguuagcugucuuguuccccaagugagcucauaaccugccaugggcaaguuuuauaucagguaguguacacaggugagagguggcauccuucaggguacgugcuguuuucacagauagagucaucaacugguugggcgggguggcucacgacuguaauuccagcgcuaugcuggcgcugaggcaggaggaucacaugagccuagcaguuugggaccagccugggcaacauaggcagaucccaucucuacaaaaagauuuuuuuuuuuuuuuuuuuuuuuugagacggagucucacucugucgcccaggcuggagugcaguggcacgaucucggcucacugcaaacuccgccucccggguucaggccauucuccugccucagccucccgaguagcugggacuacaggcaccugcaaccgcgcccagcuaauuuuuuguauuuuuaguagagauggaguuucacuguguuagccaggacgucucgaucuccugaccucgugauccacccgccuccgccucccaaagugcugggauuacaggugugagccaccgcgcccggccaagauuuuuuuuguuuguuuguuugagacggagucuugcucuguagccaggcuggagugcaguggugcgaucucggcucaccaugaucuugacucaccgugaucucggcucaccgcauccuccgcuuccuggguucaagugauccucuugccucagucuccugaguagcugggacuacaggcacgugccaccacucccaguuaauuuuuguauuuuuagcagauacuggauuucaccauauuggccaggauggucucgaucucuuuacccaugaucuguccaccucagccuccuaaagugcugggauuacaggugugagucaccgcgcccggccuacaaaaagauuuuuaaaaauuagcugacuguggccggacaugguggcucacgccuguaaucccagcacuuugggaggccuaugcgggcggaucaccugaagucaggaguuugagaccagccugaucaacauggagaaaccccgucucuacaaaaaauacaaaauuagccaggccugguggcgcaugccuguaaacccggguacucgggaggcuggggcaggagaauugcuugaacgugaaagucggagguugccgugagccgaguuagcgccauugcacuccagccugaucaacaagagcgaaacugugucucaaaaaaaaaaaaauuagccaacuaugguggcaacugccuguacucccagcugcuugggaggcugaggugggaguuucacuugagcccagaagguugaggcugcagugagccaugaugaugccacugcacuccagccugggcaacagaguaugacucuuucucuaccaaaaaauuaauaaagucaucaacugagaagccaugugguggcgagccucuauaguccuagcuacucaggagguugaggugggaggauugcuggaguccaggaauuugaauuuggccuaggcaacauaaugagaccccugucucuuaaaaaaaaaaauuuugaaaaggucauuaacucagcguccaaacacuagucugugaucuugucucaaaucuaguaguaagaugacauaacaacauuuuagaugugacuuuucuuccaagcagaaagaaagcaguuguugguggccagguaugguggcucaugccugcaaucccauuacuuugggagguggguugaucgccugaggucaggaguuugagaccagccuggccaagauggccaaagcuugucucuacuaaaaauagaaaaaguuggucaggcgugguggcggguuccuguaaucccagcuacucgggaggcugagacaggagaaucgcuugaacccaggaggcagagguugcagugagccgagaucgcgccacugcccuccagccugggcaacaagagccaaacucccugucaaaaaaaaaaaaaaagaaagcaguuguuggacaguggguuggccauucuuagaacgacuuggaggcuuauuuuauucuggguuguucuaaaaaggacaggacauuuacuggucauaugugauaaaauaaauagucuauuaaaugaaaucuaauuauuguuaaucauugaugcccuauggauaaugucaaaagucaucagacuggggaugguggcucaugccuguaaccccagcacuuugguaggaugaggccggcggaucacuugaggucaggaguucgagaccagccuggccaacauggugaaacuucuuaccuacuaaaaauacaaaaauuagccaggugugguggugugcgccuauaguccuggcuacuugagaggcuaaagcagaagaaucgcucgaaccugggagauggagguugcagugaaccgagaucacaccacugcacuccagccugggugacagagugagacucugucucaaaaaaagaaaaaacaaagccaucagucuuguaauuaaacgugauuugucuuuauccacaugcaguuuugugcguuacuaucucuguacuaacuccuguccguguucucugcccguaauguugaagccacagcugccacaggucacuaccagccuccgccuuguggcauuggaaugaguggugagagagaggcuggacugggccgggcaaccccuuacuccgaaauaaaaagaggguugaguacaaguucaauaauaagucaggucuaguguuuucucaagucugacugaagaaacacaaaguggucuccugaccccuacuacuuccagugugcuuuuuguaucccgaggauauugggugugccaaacacacggauuuauuuccuauuucuaauuuuaaguauccugaccauuccuauccauucuccugucugaucauccuuuaccuggccuccuacuuggaugugcucaaccaaccucugguuguguuuugugcugauuaacuucgaguagucucccaggcuuccuagaguuguuucucuuuuuuuuuuuucagguggagucuugcucugucgcccaggcuggagugcaauggcgcgaucuuggcucacugcaaccucagccucccagguucaaacaauucucaugccucagccucccaaguagcugggauuacaggcgugcaccaccaugaccggcuaauuuuuguauuuuuaguagagacaagauuucaccauguuggccagcuuggucucgaacuccugaccucaagugauccacccgccucggccucccaaagugcugggauuacaauaggcgugagccaccuugccuggccuagaguuguuucucaugcaaaccuaauggguucuuuguuuaacauuugcaguggcucccuauugcucuuaggauaaaauccagacuccuuagcauagcucuaaggcccuuccuauuccuaggccccauuaaucguuaucaucucuaaccaccacuaccaccacugccaucuaguuuaguuauagguauaaaucuguauggauucaaaguccucuuuagccuauuucugucucucucucuuuuuuuuccaugucauaaguuuauuuacaaacaucuaguaugucauauaaguucaagucuuugauccauuuauuuauuuauuuuuaauagagacagggucucuguguugcccaggcugguuucgaacuccugggcucaagcgauccucacgccucagguucccaaagugcugggauuacaggcgagagccacugugcccaggcuuauuuuucuuucuuuuuuuuuuucuuuuuuuuuucugugauggaguuucacuccuguugcccaggcuggagugcaauggcgcgaucuuggcucacugcaaccucugccccccagguucaagcgauucucuugcuucagccuccuuacuagcugggauuacaggcauguaccaccacauccggcuaauuuuguauuuuuaguagagaugggguuucuccauguuggucaggcuggucucuaacuccugaccucaggugauccgcccgccuuggccucccaaagugcugggauuacaggcaggagccaccauacccggcccggcuuauucacuuuuuaaacagauuucaucuauuaaaacaccuccagucugggcgugguggcacacgccuguagucccaguuacuugggaggcugaggcaggagagucgcuugaacccagcaggcggagguugcagugagccaaaaucgcaccacugcacgccagucugggcaagaagagcgaaacuccgucucaaaaaacaaagaaacaaaaagccugccgggcacgguggcucacgccgguaaucccagcacuuugggaggucgaggcaggcggaucaugaggucaggagaucgagaccauccuggcuaacacggcgaaaccccgucucuacuaaaaauaugaaaaaauuagccgagugugguggcaggcgcccguagucccagcuacuugggaggcugaggcaggagaauggcgugaacccgggaaguggagcuugcagugagccaggauggcgccacugcacuccagccugggcgacagagcgagacuccaucucaaaaaacaaaaaaccugcucuuccuaucuguuaaguggaugaacuaaaacauccuuguuucuuaagcaguuggugucuugcuauuaaaaaaggugcugugaauccagauccaaaguacaaagucauccuaguuaguaaccgccauuuguuuuccacugaaaguggcaaaugcuuuccugggcagcuuagccaguuucugcagcuuaacagcugaugccuagaaguucuuccccgaccuucuuagauugauuugucauugguucucagcaggggacacuuuuacuucccaggggacauuuggcaaugccuggagacggggaguucucuacuggcaucuaguggguggagaccuccugaguuucuggugaaugucuggaguagggcuugaacaucuguguuuucaucagucuaaugaugcuguugguccagggagcgcagucuugagaacugcuccuuaaguagauacccaaggcugcaagauagagggaaaagaauguggggaguuguuaagcauuaaaugugacagaaaaauaugaaaauaugaaaauaccuagcaaaugguaagugcucauguggcauaagaggggggagcugaaucccuuuuuaaucaucucccagucaggaguauuauuccuuuagugguuuacugagaccacuccaguaguauaagcgaggagaaucagccucauccaauacucugacauaguuuaauauuaauugaauacuguggcuuccuuagccauuauugaagugcauuagggaacagcccuaaagcuguagccuguguauuagucuguucucaugcagcuaauaaagacauaccuaagacuggguaaauuuuaaaggaaagagguuuauuuaacucacaguucagcacggcuggggaggccucagcgaucguggcggaaggggaagcaaacacauccuucuuaacauggcagcaggaagaaugagcaaaagggugagccccucauaaaacuaucagaucucaugagaacuuacuaucgcgagaccagcauggagguaaccgcuccugugauucaguuaccucccaucaggucccucccaugacacguggggauuaugggaacuaaaauucuaguugagaucuggguggggacacagccaaaccuuaucaguuuguuuguuccuucacagauauagccuggugggucauguacucacaguuuucuuuuguugagaacauucccagagugauuuucuuuguuuuuuccuuuuuaggaacaaaacauaacccuuucauuuguacugccuccuuccacacgagugccccuuuggccaaagaagauuauuaucagauauuaggagugccucgaaaugccagccagaaagagaucaagaaagccuauuaucaggucuguauggaagucagguuuuggugaccaaauuguaguaggaauguuguugaucccaugugauccugaucaguacagcguaugugcccauaugaauaggucucaugagcugauaguauagaagggugugauaaagcuggacuuugcuagacuguuuuucgaugcacaaugcuguagagguuggugcuucagaaaaaagaggugaguccaaaccagagauuuuaagaaguuuuuuuuucuagagcuguuuucauaauuaaauuuaaucuguauuuucugaaucaguagauaugcuagucuaaguuuuagguaguuauuuuuugcauccagauaaaaguuuagagguuuagaauuacuuccuuuccuuucuuuuuuuuuuuuuuuuuuuuuuuuuuuugagauggagucucacuccauugcugaggcuggagugcaguggcgcaaucuuggcucacugcaaccucugccuccuggguucaagcaguucuccuguguccgccucccaaguagcugggacuauaggcaccugccaccacacccggcuaauuuuuuuuguauuuuuaguagagacgcgguuucacuuuguuggucaggcuggucuuaaacuccugaccucaggugauccaccugccucagccucccaaagugcugggauuacaggcgugagccaccgcgccuggcccuuucuuaaccuggaaaaugugaaauucccauuguaucccagggucuauuaggguaguuaggguagcugaguaaaguuguauacgagaugucuacaccacugguuccuagacccuugguuugcucugaccaacaaaauaaaaucaauauuggaggcaccauuguaggauugacagcuuuuuauaagugcacaguucacuggaguugugcaccugucaccacagucaacuuuaggacauuuucauuaccucgaaaagaaacucuguauucauuagcacuccccuuccauuguccucucuccccggucccuagcagcugcuaaucugcguccugccucuuuggauuugccuauucucaauauucauauacagggaaucauacaauauguauccuuuugugugucuuggcuucuuucauucacauaauguuuucaggguucaucuguguuauaguuugugucaauacuucaucccuuuuuauggucaaauaaucuguugcauggauuaaucacauuuuguuuauucaucguuugauggacauuuggauauuuuccacuuuuugcuaucaugaacagugcugcuauauagacauucauauguaaguuuuuguguagacauguuuucaguucucuuggauauuuaggaguauaguugcugagucauaugguaacuggauguuuaaccuuuugagaagcugccagccuuuuucaaagcagcugcaccauuuuacauucccaccagcagcauaugagggccaugauuucuccacaucccagugaacacuuaacuauuaucgucugucuuuuuaauuacgacccuagugaauaagaaaugcuaucucguuagaguuucgauuugcuuuuucccugaugacuaaugauggugagcaucuuucuugugcauguuggcuauuaguaugucuuuggagaaacguguguuuggauccauugcccacuuuuaacuggguugucuuuuuuuuuuaauuggguuguaauggaaugaacagaggcauggggacaggaagcagagauccuggccugugaagagcgaauggccugucucuuccugagcucaagagucaggugccugauccaagagugggaaaagauugaaaagauggaggcuggguuggacucacaugacaguugauuugaggcccuuaguaagucccagagacauaauuuaagagaaagacuuaauuuagagaaccauucagauuuuuaggcacggaaguaaaaagaucagguaaagcuguagcaauuacuguauuuuauuuaccuacaaaaauaauugaaacagcagagacgucuauuuauucagucauuuucuucccuuuuuaaaaauuuuuucuuuuuucagacagagucucgccguguggcucaggcuggagugcaguggugcagucuuggcucacugcaaccucugucuccugggcucaagcaauucuccugccucagccucccgaguaccuguguuuauaggcgcgugugaccauaccuggcuaauuuuuguauuuuuaguagagaugggguuucgccauguuggccaggcuguucucaaacuccugaccucuggugauccacccagcucagcaucucaaagugcugggauaacaggcaugagccacugcgcccggcccccuuuuuaaaaauuuguuuuucuuuuuuguucauuuaccuauucuaagccaugcugggugcuaagggcaaagauacaucagaaucaguuccugcccucaaguuaagagauggauacauuaaaacagaucauuauuauuauuauuuuguggggcggacagaaucucacuccgucaccuaggcuggagugcagugccucgaucucugcucacugcaaccuccaccucccagguucaagugauucucgugcuucagccuccugaguagcugggaccacaggcaugugccaccacgccugacuaauuuuuucuauuuuugguggagagggguuucgcuguguugcccaggcugguguugaacuccugagcuuaagugaucugccugccuucacuucccaaaguguugggauuacaggcgugagccacugcacccagccgagagacaacuuuuauaaagggaacauaauuaugacugguauuugggguucuguuguaucggggguuuuguuguuucugguauuugggguucacauuguaucuggaguaauuuaucauguuuuucccuuagcuugccaagaaguaucacccugacacaaauaaggaugaucccaaagccaaggagaaguucucccagcuggcagaagccuaugagguaauaugacuucggugcaugcggucacugcuguucagcuauguguaugaaucaaagguugcauugcuaccugggacagccuggugugucauacaguccagugugaaggccaugucccugcgccaaguaaucuuguuaagaaaaauaaaaaaaaagagauuccaggccaagcaugguggcucacuccuguaguccuagcacuuugggaagcugaggcaggaggaucacuugaccucaggaguuggcuugacccuaggaguuugagaccagcuugggcaauguaguaagaccacgucucuacaaaaaaaaaaaaaaaaaucaccaggcguggugguggcgcaccuguaaacccagcuacuugggaggcugagucagguucaucacuugaggggcucaaagcugcagugacccaugaugccaugauugugccauagaacuauggucugggcaacagaaaaagaccuucucucaaaaaauaaaaaauuaaaaaaaaaacaaaacaacaacauucuaagacuaacuuggaaucucaaugaagaacaggauccaggccaggcgugguggcucaugccuguaaucccaacacuuugggaggccgaggcagguggaucaccaggucaggagaucgagaccaucccggcuaacacggugaaaccccgucucuacuaaaaauaaaaaaaaauuagccgggcauggcggcaugcgccuguagucccaggugcuggggaggcugaggcaggagaauggcgugaacccgggaggcggagcuugcagugagcugagauugcgccacugcacuccagccugggcgacagagcaagaccccgucucaaaaaaaaaaaaaagaacaggauccaauaaucuguacuaauaaaguuccccagguaauuuacacuuguagcuggauuugggaauucacaguuggauuaauuaauucagcccuuauucaaugacauccccuuccuccaccucagggcaucacugcuuuuuggggauagagguuauuguaaaaguagaagcccauuauuguccuauaagaaugucaauguaaucagaggacaaagcauacaucucugaaaacagcuauugaccccacuuccauaguuuucugaaaguagaccuuuuucccagauuuuuugacaaucuuuucuuuuuuuuuuuuuuuuuuugcuuaagagacagggucccucuauguugcccaggcuggucuugaacuccugagcugaagagauccuccugccucagccucucaaauugcuaggauuauaggugcaaggcaccagaccugcccgacuuuggccauccuaaagggguucaguauauauaggagcucauauaucuauaagaguagacagccacguagaagaacaggcucaacucaguaaaucuuuuuugaguaaauaucugucaacuagaucuaaugaaaaguuuauuuacuaguguaauuuuaaaauaauauguucuuauuagguaacucaaacuaauugauaacauaacuaaacagucuuggaaccugcuucuauggaagauaagauuaauuuuuuuuuuuuuuucaagaguugaggucucagccaggugcaguggcuuacgucuauaaucccuauaaucccagcacuuugggaggccaagacaggcagaucaggaggucaggaguuugagaccagccuggccaagagaccagccugagcaauauggugaaaccccaucucuacuaaaaauacaaaaauuagccaggugugguggugggugccuguaaucccagcuauucaggaggcugaggcaggagaauugcuugaacccgggaggcaucagugagccgaagauugcgccauuguacuccagccugggcaacagagcgagacucccaaucaaaaaaaaaaaaaaaagaguugaggucucacucuguuaccuaggcuggaguguaguggcgagaucacagcucacugcagucucaaacucuugggcucaagcaguuuuccugccucaaccucaacuuccugaguagcugggacuacagguuccccacugcacccagaagauucaauuuuuaauggggcggggggguguuauucuugugaauguguuuuuccacaugguuaguugaucugauguuucugccaggggcaugaguuuuggagaguccuaauccaccguguugcugacuucugucuucaagggggauguuauuaaacggaccgagccucagaaccuaagagcagcaauuccuugggaagggcuggaaccaggagauaaaacccaccaggaagucaugaacucccaccugacuccuccucugccagccuuccuccuuugcaucuuaacugggugcccuaaaaguuacccuaggcaccaagcuguccuccaccugcuuucuuagucccccuccauucuagguggaagugucuuuuccuuuggaggaagcguacucuuuucuguuuggccuuaaggauagugccuauuuuuuugagauagugucucacuuuguugcccaggcuggagugcaauggugcaaucacgguucacugcagccucaaccucaaccuccgugcucaagcaauccucccaccucagccucccaaguagcuggaacuauaggcgugcaccaccauucuugguuaauuuuuuuguauuuuucuugugaugggguuucaccauguugcccaggcuggucuugaacucaugaacucaagcaguccaccugccuuggccucccaaaguccugggauuacaggugugagccaccauacucagccuagggcagugucuuuuuaauuaaagaaaaaaaaaguaagacaaacacauaaaaaaaagauacaaagugagggccaggcacgguggcucacgcuuguaaucccagcacuuugggaggcugaggcagacggaucacgaggucaagagaucgagaccauccuggcaaacguggugaaacccugucucuacuaaaaauacaaaaaaauuagcugggcgugguggugcaugucuuuagucccaacuacucgggaggcugaggcaggagaaucacuugaacccgagaggcagagguugcagugagccgagaucgcgccacugcacuccagccuggcgacagagcaagacucccgucucaaaaaaaaaaaaaaagauacaaagugaauacuacauuuuuccuugucccucccuaaucccccuuuuugagguaguuaguccuuauuaacaguuuugugggccaggcccaguggcucaugccuguaaucccaguauuuugggaggucgaagugggaggaucgcuugaggccaggaguuugaaagcagccugggcaacauagcaagacccugucucuacaaaaacuuaaaacaauuugccaggacugguggugugcaccuguagacccagcuacuguggaggcugaggcaggaggauugcuucaaccugggagguugaggcugcagugagcuaggauugcaccacugcuauugucguugcuguuacuucuguuacuccgguuguucuggcuugcagaaaaccuuucgaugaagguaaggguaggaagcauaaauucucuacgagguaauguccccugaggagagaggugaagugugaaucugugaagaauccagggugccugugaggucaagcgaggaucaacacaaacauuuucccagcaugcgcgacggcgggagaguucgugagacuuuuggaagcacuucacgcccuacacuuagcauucaguuuggucaucucaucccucuucuaggugcuagucacaggcccaccccaaccucauaggauguguuugcacacagggccacuuaauaaauguuauggcugccuuauuugcugugaacucuugucuguauuccugggccuugguagaccugggaugcccaguggcucugccuuucacuguagguuuugagugaugaggugaagaggaagcaguacgaugccuacggcucugcaggcuucgauccuggggccagcggcucccagcauagcuacuggaagggaggccccacuguggaccccgaggagcuguucaggaagaucuuuggcgaguucucauccucuucauuuggagauuuccagaccguguuugaucagccucaggaaguaaguuccucacuuggaagaauuauucaaauuuuagacuaaguaugggucaaacaaauuuuuuuaucaguuucuguuucucagaaaggcaaggcagcuuaaauggagugaucuggaggcagccauuuuaguagaaaauaauuucaguauuugaaaaaucgcauagguaguaaugaguauguccauucugaugguauucuuaacaguugcauaaugagguagcaccuaaggcuuucagagcccaugagggugugaguguugucucucaucugcuacaguauuccaggagaguucuguccggugggaaggcacugcugauccucucucauuuauguccuuauaagacacugucagaguggaagagagaggggauauauuuaugaucuaaauuaugauuguggaucauucaggcuguuuuuaagugccauguacgaguauuuaucugugaacauuuucagucuguugaaaguacguuuucauuuaagucauacauuaucucuuaaaaaucccaaagaguagggcagaauucguucagugaguccuaccuaugcuuacuuggcagagugcaaguaaguacaguggugaaagagugacugaaaaugugggccaguacccuccuuucccuuuagagccgagcgucaguuuuggucguugcaaacaaaaguugacaggcugucccuugguuucuuuaguacuucauggaguugacauucaaucaagcugcaaagggggucaacaaggaguucaccgugaacaucauggacacgugugagcgcugcaacggcaaggggaacgagcccggcaccaaggugcagcauugccacuacuguggcggcuccggcaugguaaggcucugcccgagacuccaccucccacggcuugcaccacugacugagaagagcugguuguggcacugcucccagagaacguaugcugggaauugggggaguuggugaacucagccuggcugucuuucccccgugacccugaggagacgagccugugcuccucuuucccugauaccacaggcucagcaaccagagcacagcagcuccgggggcggggcgggggauugcauccaguugucacuuucuucuuuauuuuucuaacaauugcuuugguaauucaaggggaaauaaucuuuuuuaaauguacuguucagcucccaggagucuucagguacuucuguagacaggcgguaucauauuuuucagugucguguggucaaguugaugaucuggagugcagaaguuuguguguucuagaaaaucagaugaacagauugaggcccugcaccuggguuccuaggcaguguguuugagugcacaugcacauaaaaaacaagccuuaaagagacauuuuucuuacgcacauuguggucccagaaccacccaucaguuuaccugcguacuuagguuaccauuuuucuuguuuuuaucaggaaaccaucaacacaggcccuuuugugaugcguuccacguguaggagaugugguggccgcggcuccaucaucauaucgcccuguguggucugcaggggagcaggacaagccaagcagaaaaagcgagugaugaucccugugccugcaggugggugcuugggcccgccauguccaggagcuuggagagggcagacaggguugaggcuaccacaccguguggagaggguggacagggccgaggccacugcacugagugugagugggcucuugguagaaguuaugguugaggcccuggagccccaggcuggaggaggaacuggagucuccuugaaucuuucuguuucugccaguuauccuuaaaauuuacacuuugcaugucacaauggggagaagagaccugacgugccuacucugcuucuuccuggugagggagcagcuuccaacccccgggcuccucuccucucuccccugucuuagucaccgaagccaucauugucccugcugccacccuaucuacaucagccccacggaucccaccccucacuccaugucuacuguucccuugcccaaaacucacuuucugcuuucuuuuuucgguuaacuuuauucaucuuggagaucccagcuugaguaucccuucccuagcuagccucacacccuccucccuguucuuuuuuuuuucuuuuuugagacggagucucgcucugucacccaggcuggagcgcaguggcccgaucucggcccacugcaagcucugccucccaggcucaugccauucuccugccucagccucccaaggagcugggacuacaggcaccugccaccacacccagcuaauuuuuuguauuuuuaguagagacgggguuucaucguguuagccaggauggucucgaucuccugaccucgugauccacccgccucggcuucccaaagugcugagauuauagucaugagccaccgcgcguggccugcuuuacuguuguuuagaugucuguuucucuagaguugugagcauuuccauugaagagcaugucucuguuuguaguuaugcauuagugcuaucguuugguuaacacccaucaccccagugagaccaugaacucccugagguacugccuagaccaagccugaggcaggugcucagucaucaggugucuguguugcaucucuggaagguuacccaugugccucuuagauaaugacauuguuccucguuaauaagaaacaggaguggggaagaagcuguggguuacaaguggaucuuggguggaaagugcugugggaggucucacaauaacugcucccuuucuuuuuuuucuuuuucuuuucuuuuuuuuuuuuuuuuuaagacggagucucgcucuguugccaggcuggcguguaguggagugaucucggcucacugcaaccuccgccuccuggguucaagcgauucucuuuccucagccuccugaguagcugggacuacaggcgugugccaccacgcccaguuaauuuuuaguagagaccagguuucaccauguuggccaggauggucucgaucucuugacgucaugaucugcccgccucggccucccaaagugcugggauuacaggcgugagccaccgcguccugccuaacuucucccuuucuaaugucccuuguaggagucgaggauggccagaccgugaggaugccugugggaaaaagggaaauuuucauuacguucaggguaggugcccugccccgcacagcuucuguugggccuuuccucucuucggguggguguggcugaggcugcucccauguaaucaaagcuucacaggaacaugucucgccauucauguuucugaggggcacaguggccaccuagaugugguuuuuagcuguuuguuaccuucaagauucugugccuuguguggagagaagacaacuucuucaacaugcuaacaaguuagaaauacaggucacauaaaaauacaggaaacaucuuguguuuuuaugauaagauuguugaugaggcagugagugugaaaguuacaauuuuacauacuguauacaggggcaaaccuugguuuucugagaugguggaaacauuaaugaagacaaugccuucuacuggcaauugcccuccuauguguacaccugagaaaaacccacacaagccuagcaggcgauagguacaaaggggugcacaagaguccuguccaugguagcaagacacugccuuccuccaacaagagaauggcucagugagccgugguggucagaggcugcugcagggcagucggaaggaaagaaugagagcugaacucaagggaugcuccaggcguugcagguacagacagcagggauggaaggcagcuugccaguggcuguagggccucagagaccaucuguguaaaguuuuaaaaccugugagauggcauuauguauuauuuagggacacggaaauacauaguaaguagaagcuuguaggaaugauaaauguuaaagucaggguugugguuagcugaggagggcaagacucaccgguguuuaugauguuuuauuuuauuuuacuuuauuuuuugaggugggguauugcuuuguugccuaggaugaaaugcaguggggcagucuuggcucacuguagccucagacucccugggcucaggugauccucccaccucagccuccugaguagcugggacuacaggcacacgccaccaggcccggcugacuuuuguaucuuuaguaaagaugagguuucaccauguugcccaggguggucucaaaccccagggcucaaaugauccacccaccuuggccucccaaagugcugggauuacagguaugagccacugcgcccggccugugauauuuuguuaccuccacuggguuguggguaugacaugcuuguuauauuauuuacucuucccuuuuuuuucuuuuuuuuuucuggaaagagagucuugcucuguugcccagucuggagugcaguggcaugaucucagcucacugcaaccuccaccucccagguucaagcgauucucuugccucagccuccugaguagcugggacuacaggcaugcgccacuacacccagguaauuuuuguauuuuuaguagagaugggguuucaccauguuggcaggcuggucucgaauuccugaccucaggugauccacccaccuuagccuuccaaagugcugggauuacaagcgugagccaccacggcuggccuauacuuucuaauaaaguaagauuuuuuuuuuuuuuuuuuugagguggagucucgcucuguugcucaggcuggagugcaguggugugaucucuguucagugcaaacuucaucucccagguucaaguggaucuucugccucagccuccugaguagcugggauuacaggggcccgccaccacaccugguuaauuuuuguauuuuuaguagagacaagguuucaccauguuggucagucuggucucaaacuccugaccucaggugauccacucaccuuggccucccaaagugcugggauuacaggugugugccacugugccuggcuaaaguaagauuaaaaaaaaaaaaucaaaagccaguuuuacauuuuuguuucccuucacgauugaauggcuugaucugagacugaggaaauccaggcacgcuuccauuucggcauuucaaguguguagaacauugcaguguugaaauauguagaacaugucauuccugggccugggauggugucuccuuguuggaaggacaguucuuucccucaacacugcacuuuauguauggaagggguguguaguuugucaggucugagcuugggccuggccaggcaugcagcugguguuuagucugcaguggacuuaucuucacaugcaucugucauguuuggccuuaggugcagaaaagcccuguguuccggagggacggcgcagacauccacuccgaccucuuuauuucuauagcucaggcucuucuuggggguacagccagagcccagggccuguacgagacgaucaacgugacgguaagagggugugagaacaccuuugucaccccuguacuuuauugcucuuuuucugaaauggaaaagaacugaccaguggccuggaacccaugagugaccagcaugugggggggcacucacaggggaggacaugaggaauuuuaggcugcuccuugaguguggaccacaagccacaggccuugagucuauaaucgcaugggaagcaguuccuggcuggcaucacucccacacugguuagcggggccugggaacugggcgcauucaggacacagaaggguucacccuggguugugcucucugcacuugcuucuguccagugucuggcuccaagagcagaagacucgggcggugcauaucccuuuugccacagugauggcugccugugugcugccagcaccugucccccaccucucucuugaccugccccuccagcucuucccaccuccaggccacaucauucucuguauucgccucagaaccuucuccagcuucuuuguggggaaccuugggguaaccuccaugaaggaggugggcauuuugggccaaggcuuucuccuccaucugggggcuauucccuggcuucuccaggguccugugguuccaagggccagggagcgaccucagccacgcacccuguauuggcuuuuccugcuuugcucccucacuccugcuuccugggcucacuugcccaaacucuugcccccucauccuagucacaggcucugcucugggcagacccaacuuagcucauuuccaugugcuugugggcgggcuuggcccagaaacccaaguggugguucuuuuuuuuuuuuugagauggagucucgcuuugucgucaggugcacgccaccacaccuggcuaauuuuuuguauuuuaguagagacaggguuucaccguauuucccaggcuggucuucaacuccugaucucaggcaguucacccgccucggccucccaaagugcugggauuaaaaggcgugagccacugcgcccagcccaguggcaguucuuuuuuuuuuuuuuuuuuuuuuuugagacagagucuugcucugucgccaggcuggagugcaguagcgcgaucuuggcucguggcaaucuccgccucccagguucaagcgauucccaccucagccuccugaguaccugggccuacaagcacgcgccaccaugccuggcuaauuuuuuguauuuuaguagcgaugggguuucaccauguuggccaggaaggucucaaucaccugaccucgugaucugccugccucagccccccaaagugcugggauuacaggcaugagccacugcgcccggccuuuuuuuuuacccacccccuccaccaccgcucugccgagacagagucuugcucugucagccagagcuggagugcaauggcacaaucuuggcucacugcaaccuccgccucccggguucaagcaauucuccuaccucagccuccugaguagcugagauuacaggugcacguuaccaugcccugcugauuuuuguauuuuuaguagagacgggguuucaucauguuggccaggcaggucuugaacuccugaccucgugaucagccugccucgaccucccaaagugaugggagcgugagccagugguaguucuuuucaaggaauuccuaucaagauugucuucauguagugaaaacuuuuuauuugagcaacuggggaccaggggaaaccacagauuuucuuucuuuauagauccccccugggacucagacagaccagaagauucggaugggugggaaaggcaucccccggauuaacagcuacggcuacggagaccacuacauccacaucaagauacgaguuccaaaguaagugcccccuaggcuguggccaagcccgccugguccugcgguggcacugcccuuggagcucuguggcuugggcagguuacugcucccuguaagucaggugguuccugcccgaguuaucugucuguaaaguggacauaguagaauggucaacuucuuuuuuuuugagauggagucucgcugugucccccaggcuggagugcaguggcgccaucucggcucacugcaaccuccgcuucccagguucaagcgauucuccugccucagccucccgaguagcugggauuacaggugccugccaccaugcccggcuaauuuuuuguauuuuuaguagagaugggguuucaccguguuagccagaguggccucaaucuccugaccuagugauccacccaccuuggccucccaaaguguugggauuacaggcgugagccaccaugcccggccagaauggucgacuucuuggaguuguugggagaauuaaaugaacaacacauaggaauugcuuugcugcugcugcuauuguugauuuucuucuuuuuuuuuugagaaggaaucugucacuguguugcccaggcuggaaugugguggugccauuucagcucacugcaaccuccuccuccccaguucaaaugauucuccugccucagccucccgaguagcugggacuacaggcgcuuaccaccacgcccagcuaauuuuuguauuuuuaguagagacggaguuucacuggccaggcuaaucucgaacuccugaccucaggugaucugcccaccuugacuucccaaaguggugggauuacaggugugagccagcacgccuggcccguugcuuuucuuguugauguuacuagcacuguuaggagcuggagagguggccugggcagagugcuguggguaccuagggcgggacaugccugacuccccucgggagcacucaugcuuuuuguuaauuagauaauuucuuuuuuuuuuuuugagauggugucuagcucugucucuagguggaguucaguggugcaaucuccaccucccagauuuaagcaauucuccugccucagccucccaaguagcugggacuauaggcaugugccgccacgcccagcuaauuuuuguauuuucaguagagacgggguuucaccuuguuggccaggauggucucuaucuccugaccuugugauccgcccaccuuggccucccaaaaugcugggauuacaggcaugagccacugcgccuggccuaauuagauaauuucuuacuugcuucacauacacacugguaaaaucuguuuccccuccuguaaacuguauuuagcauagccacagugacacuuguuuaaaugacuuaguguaggguguuuuaggagcuuuucuguacagaagcuuugagggcaugguccuuagguucucaccgcugcacuggcucaggguguccgccccugccaagguugggucccucucuucccaugugcugcgagggugcuggcugccugugaguucuuuccaaagcuucccggcggaagccuuggcugcugacucugcucgguccacaggaggcuaacgagccggcagcagagccugauccugagcuacgccgaggacgagacagauguggaggggacggugaacggcgucacccucaccagcucugguaaggagucugaagacuacauggugacacgugggggccucagagccccccaggguauggacaauucagggcagcauguugggguuuccacuucggguucuucaugaagccuuuaaaaugugcaguugaaagaggggggcugugggcggggacagcgggcagggagccgcagcccccaguccaagcuucgccuccucucucuguguguguuucugugcugaggugagagcaccagggcacuuccugcaggcagcucugcgugucucagacccaguguucugaguucuauucuugguucugccacuugcccugugaccucggacaaauccuucccugagagcuccuggcaaaagcguaaggagagagcauggauuggaaggauuugugcacuucccaccugggacacuccgccaggauuucagagugucuuaaaacaacagcagccacagcaguggagccgcagucagcagacuccguccgccgcuuuagagcaggacucccuccaaguuaucuagccgugaacagaugcaccauuuacccugagcucagacaucgugcuagcgaguggcuguguuagggaucugucaccagaacaccugcugugggcgcugagacaauggcaccccagcugcagccccucuucccauggggucuggggccucuuuccugggacuccuggcucagggcagggcaggcugugcccagggguccuugguucaggcggcauguauuuccuccucauugcaucauuuuguuuuuguuuggauccuggguggaguucucagaacuugagcagccuuagauuagugcaugguaauucguagcagguguuuggagcugggggccgauuuuccaauaaaguggaggauuuggagcuccaggggcaggggcaggggcugggauggaagucccuggaauuucacugagcuccuguugcucccaggggacuggaauuccucuguuaaaaagcagcugccggccgggcgcaguggcucuugccuguaaucccagcacuuugggaggcaggggcagguggaucacuugaagucaggaguuugagaccagccuggacagcauggcgaaaccccaucccuacuaaaaauacaaaaauuagcuggguaugguggugcaugccuguaaucucagcuacucaggacgcugaggcaggagaaucgcuugaacccaggaggcagaggaugcagugagccaagaccacaccacugcacuccagcuugggugacagugagacucucugaaaaaaaaaaaaaaaaaaaaaaaaagggccuggcgcgguggcucacgccuguaauccuagcacuuugggacgccgaggaggguggaucacgaggucaggaguuugagaccagccugaccaacauggugaaacccugucucuacuaaaaaaaaaaaaaaaauacaaaaacuagcggggcaugguggugggcauccauaaucccagcuacucuggaggcugaggcaggauaauugcuugaauccaggaggcagagggugcagugagccaagauugcaccacugcacuacagccugggugacauagcgagacucugucucaaaaaaacaacaacaaaaaagcagcugccacaaaacucuguagcccaaccagguuccaaaugucacuuauuuuaaugguuugguacauauacuguguauauguauacuaucuuuuguucuuguuguaucucuugaacuaaaauagaagugguaauagaguagcuauuccccggaacucuaaucagugcaccuguggcuucuccuuccucaaacccuacaaucacauaacaugcgagauugguuccauagacagcuguccuucccuccucccgcccaucaggguagcuugaggugugcuacggccgggcccuggguggguucguggguguugcuuacucuguuggagguuggguauuacuggucaccaguugauguuuugacccucucucugauacuguaaguugaaaguugauuccgccacccacugagauccuuugucacuuccaugguuacuuguccugaucacucagccucacucagcuguucccucacucagccaggaugucuucuccugugugcaagacacugucagcucuuccuuuuaaagaucuuggugaggccggaugcagcggcucacaccuauaaucccagcacuuugggcggcuaaugcaggaagaucacuugaacccaggaguucgagaccagccugggcaauauagcgagacucugucucuacaaaaaauuucaaaacuagccaggugcaaaguaguaugcaccucuaucaccagcuacuugggaagcugagaugagaagaucacuugagccuuaguacucaaggcugcggugagucaugacagcgacacuguacuccagccugggugccagggcaagacucugucccuaagcauacaccgucacaugucagucugcugccugugggugguuaagucucucauuauacugugaagacaguuaguuuugcauccacauaugacaguauuacaggacauauaauucucauguccuaagaacuuaagcaacagugggauuuauuuauuuauuugaggcagagucuugcucuguggcccagccuggagugcaguggugcagucauagcucacggcagccucaaacuccuggacucaagugauccucccaccuuggccucccagaguguuggaauuacagacaugagccacugugccugaccagcauaguuuuugaugcguuuaguaucuuaauguagcugcugaaaaccuuaagagcugaccccggucucccagaaagaccauggugugcuuagagacucagcacuugcagggauaaacagguccaucuucuggcgaacagagagggaacugggggggcuugcaauuacuaugugacuuuuugagugagagacacaguauggcuccuuguuguucuuuuuuuuuuuuucuuuuuuuggagacggagucucacucugucacccgggccggagugcaguggcgugaucucggcucacugcaacgcacucugccucuuggguucaaccaauucugccucagccucccgaguagcugggacuacaggugcaugccgccccuggcuaauuuuuuguauuuuaguagagauggguuucaccauguucgaggccggucucgaacuccugagcucaggcaauccgccugccuuggccucccaaagugcggggauuacaggcgugagccacugugcccggccuuuucuuuuuugagacugggucucacucuguuuuauguagccucccucaccccuucccggggaccuguggccccaaacuuuggaccuuucacuagcgaaggcaccuucuuacuuagacugaggccuuuacucuuuuaugcacugugcguggccuaggucucugagcacauuaaaaaugagcucuacaauuaacaugccaaguucaggucuauauucuaacucacaacaaaagugugcacuccuugucuaguaguuggcaaaucuguaacacguuugugugagaaaguaccucuagauggugucagccugggcccuaaagaaauugcagcacagcuucccuagguugagagcauuuagguuaggugccccaaauggggacaacuugcucagggagauagacugcugaugugagggaugagauggagugccugugacaaaggauugugcguggccgugacucccacaugggcuguucugcagggucuuugcgcacacagcagcauggaaucuggccaguuggucuagaguaggguuuuucuuggcagucauuauuuaccuucuuauagccaacagcauggugguugagucucagcuuuggagucagacugcaugggcucgcacucaguccucccucccgcuuguuggcucuguggccuuggguaaacccuguaaccucucugugccuccuuuuuuuguuuuuucaucugugaaauuugccuguaaggaaguguauggccuggccugggaggugccuggcacuugacuguguuuuugucacuguugcucagauagagacagcugucauaguccgucucuauuucuuguuucccugcuguggguccuugauugaaagagcaguugggagacccucaggcucugaguggccuguucaccucagucgucugcaaggugaggcauccugugccaucuuaggaguggcccccacucuucuugagguggcacuuggccgcuucuugaacgugggccccuggguggccaggcggggguaggugggcccugggaugugacuguggaagugcaggcccaugacgccaguucuuucugcuguuugugcccagguggcagcaccauggauagcuccgcaggaagcaaggcuaggcgugaggcuggggaggacgaggagggauuccuuuccaaacuuaagaaaauguuuaccucaugauaucccagccgagguaggaaaacccuggagguuuuuuuucccuuuguuuuccucugugaacuaauccugguuuucucccacuuuaaccaauauugugcccccacccccaggaguuggaacaggugccaguccaaggugugguaaaccuagcuccacuaggagcuggccucucagccuagggaauagaugacguggcaaucagccuguagugcaggacuggcugggcugccgcggccagccucuggcugugucuucuuccuggggagguggcgaugcuggggcuguuguacagccccccugcagugguggguccggcuugcccauggucacagagggcgagucaggcagagccaggccuagaacucagaucuccucacguccugccugcuuggaagcugcccuccugcguggacagcgcagggcugugcaagccugggggcugcuccagggguagcgcuugcucgccgugucaucuugggacccacuuugguuuauuaugcucaucucagcaagugggguucucgccccucucuuggcacagcugcuuuccagggauuaacagacgcuccccacagggguguguucccuugaaauguugaguauaagguaacagccuaucucuuuggcucaggaaaaagauccacuggaaacuaggccgggaagcagcagccccuccaagggccagggcaccugggagacgggaggauuccagaacagcagcacugagcucccacccgcagagccucuggacggccuuggcaacagcaaaaucaugggacaacaccucucuccacggaaaggucacaguggacagcccgggcaguaggaugcagccccagaggcugguggcaguuuccuguccauugguaggugacggccccuggcucaggcagagggagaugguuagacucuugcagggcuaaaacucuaauuuggaauugaauauuguggauaucuuaguuaaaggccaugcuuacagcuuagaaaugaagccuuaagcugcaucaaguuacgaagugauuaauuuccuucucagcaaaccuccgggagguuccagaaugaguucuuccugacagguugucuucacugggagcguggggcccccaggccccaccagcaccguccuccccuaaugaggggcccugccgaggcaucagcugcucugcucaguuaguuuuuauucccgggguaccaagcagcugcacagucggugccugggaggcacguagaggcccagagagucccuggggguucugcucugaccguguggguggugauccuugucaggauguacaguccuugcucccaccccauccgggauggccgccugucccugacuauugaguccuguuguuguaagccaggcauggagggcuccugcccuucugcugagccacagcccauugcagcacugugcuggccagacuucagcugccuugggaacugaagcccugccacuguugcuagucaggggcuugguucucccacuuacacuguugacaucuauuuucugaaguguguuuaaauuauucagugcuaaucauuguuuuuuccuuuguaaauguugauucagaaaaggaaagcacaggcuaagcaguugaagguuccccaccauucagugagagcagaacccccauuccccagccucugcugguagcaugucgcaguuuccauguguuucaggaucuucgggcugucguuagacagguuaaugaagaacacuucucaacaguuuccuuuuuguuuuccuuuauaauucacuaaaauaaagcaucuauuagugucugauuuaggaauguaaaaugauucuguauuaauguaaauaagauuaucuauugcaaaaagauauuucaaaccuaa

SEQ ID NO: 193040 - RNA, 30970 nt, Homo sapiens
uuagguuugaaauaucuuuuugcaauagauaaucuuauuuacauuaauacagaaucauuuuacauuccuaaaucagacacuaauagaugcuuuauuuuagugaauuauaaaggaaaacaaaaaggaaacuguugagaaguguucuucauuaaccugucuaacgacagcccgaagauccugaaacacauggaaacugcgacaugcuaccagcagaggcuggggaauggggguucugcucucacugaaugguggggaaccuucaacugcuuagccugugcuuuccuuuucugaaucaacauuuacaaaggaaaaaacaaugauuagcacugaauaauuuaaacacacuucagaaaauagaugucaacaguguaagugggagaaccaagccccugacuagcaacaguggcagggcuucaguucccaaggcagcugaagucuggccagcacagugcugcaaugggcuguggcucagcagaagggcaggagcccuccaugccuggcuuacaacaacaggacucaauagucagggacaggcggccaucccggauggggugggagcaaggacuguacauccugacaaggaucaccacccacacggucagagcagaacccccagggacucucugggccucuacgugccucccaggcaccgacugugcagcugcuugguaccccgggaauaaaaacuaacugagcagagcagcugaugccucggcagggccccucauuaggggaggacggugcugguggggccugggggccccacgcucccagugaagacaaccugucaggaagaacucauucuggaaccucccggagguuugcugagaaggaaauuaaucacuucguaacuugaugcagcuuaaggcuucauuucuaagcuguaagcauggccuuuaacuaagauauccacaauauucaauuccaaauuagaguuuuagcccugcaagagucuaaccaucucccucugccugagccaggggccgucaccuaccaauggacaggaaacugccaccagccucuggggcugcauccuacugcccgggcuguccacugugaccuuuccguggagagagguguugucccaugauuuugcuguugccaaggccguccagaggcucugcgggugggagcucagugcugcuguucuggaauccucccgucucccaggugcccuggcccuuggaggggcugcugcuucccggccuaguuuccaguggaucuuuuuccugagccaaagagauaggcuguuaccuuauacucaacauuucaagggaacacaccccuguggggagcgucuguuaaucccuggaaagcagcugugccaagagaggggcgagaaccccacuugcugagaugagcauaauaaaccaaagugggucccaagaugacacggcgagcaagcgcuaccccuggagcagcccccaggcuugcacagcccugcgcuguccacgcaggagggcagcuuccaagcaggcaggacgugaggagaucugaguucuaggccuggcucugccugacucgcccucugugaccaugggcaagccggacccaccacugcaggggggcuguacaacagccccagcaucgccaccuccccaggaagaagacacagccagaggcuggccgcggcagcccagccaguccugcacuacaggcugauugccacgucaucuauucccuaggcugagaggccagcuccuaguggagcuagguuuaccacaccuuggacuggcaccuguuccaacuccugggggugggggcacaauauugguuaaagugggagaaaaccaggauuaguucacagaggaaaacaaagggaaaaaaaaccuccaggguuuuccuaccucggcugggauaucaugagguaaacauuuucuuaaguuuggaaaggaaucccuccucguccuccccagccucacgccuagccuugcuuccugcggagcuauccauggugcugccaccugggcacaaacagcagaaagaacuggcgucaugggccugcacuuccacagucacaucccagggcccaccuacccccgccuggccacccaggggcccacguucaagaagcggccaagugccaccucaagaagagugggggccacuccuaagauggcacaggaugccucaccuugcagacgacugaggugaacaggccacucagagccugagggucucccaacugcucuuucaaucaaggacccacagcagggaaacaagaaauagagacggacuaugacagcugucucuaucugagcaacagugacaaaaacacagucaagugccaggcaccucccaggccaggccauacacuuccuuacaggcaaauuucacagaugaaaaaacaaaaaaaggaggcacagagagguuacaggguuuacccaaggccacagagccaacaagcgggagggaggacugagugcgagcccaugcagucugacuccaaagcugagacucaaccaccaugcuguuggcuauaagaagguaaauaaugacugccaagaaaaacccuacucuagaccaacuggccagauuccaugcugcugugugcgcaaagacccugcagaacagcccaugugggagucacggccacgcacaauccuuugucacaggcacuccaucucaucccucacaucagcagucuaucucccugagcaaguuguccccauuuggggcaccuaaccuaaaugcucucaaccuagggaagcugugcugcaauuucuuuagggcccaggcugacaccaucuagagguacuuucucacacaaacguguuacagauuugccaacuacuagacaaggagugcacacuuuuguugugaguuagaauauagaccugaacuuggcauguuaauuguagagcucauuuuuaaugugcucagagaccuaggccacgcacagugcauaaaagaguaaaggccucagucuaaguaagaaggugccuucgcuagugaaagguccaaaguuuggggccacagguccccgggaaggggugagggaggcuacauaaaacagagugagacccagucucaaaaaagaaaaggccgggcacaguggcucacgccuguaauccccgcacuuugggaggccaaggcaggcggauugccugagcucaggaguucgagaccggccucgaacauggugaaacccaucucuacuaaaauacaaaaaauuagccaggggcggcaugcaccuguagucccagcuacucgggaggcugaggcagaauugguugaacccaagaggcagagugcguugcagugagccgagaucacgccacugcacuccggcccgggugacagagugagacuccgucuccaaaaaaagaaaaaaaaaaaaagaacaacaaggagccauacugugucucucacucaaaaagucacauaguaauugcaagcccccccaguucccucucuguucgccagaagauggaccuguuuaucccugcaagugcugagucucuaagcacaccauggucuuucugggagaccggggucagcucuuaagguuuucagcagcuacauuaagauacuaaacgcaucaaaaacuaugcuggucaggcacaguggcucaugucuguaauuccaacacucugggaggccaaggugggaggaucacuugaguccaggaguuugaggcugccgugagcuaugacugcaccacugcacuccaggcugggccacagagcaagacucugccucaaauaaauaaauaaaucccacuguugcuuaaguucuuaggacaugagaauuauauguccuguaauacugucauauguggaugcaaaacuaacugucuucacaguauaaugagagacuuaaccacccacaggcagcagacugacaugugacgguguaugcuuagggacagagucuugcccuggcacccaggcuggaguacagugucgcugucaugacucaccgcagccuugaguacuaaggcucaagugaucuucucaucucagcuucccaaguagcuggugauagaggugcauacuacuuugcaccuggcuaguuuugaaauuuuuuguagagacagagucucgcuauauugcccaggcuggucucgaacuccuggguucaagugaucuuccugcauuagccgcccaaagugcugggauuauaggugugagccgcugcauccggccucaccaagaucuuuaaaaggaagagcugacagugucuugcacacaggagaagacauccuggcugagugagggaacagcugagugaggcugagugaucaggacaaguaaccauggaagugacaaaggaucucaguggguggcggaaucaacuuucaacuuacaguaucagagagagggucaaaacaucaacuggugaccaguaauacccaaccuccaacagaguaagcaacacccacgaacccacccagggcccggccguagcacaccucaagcuacccugaugggcgggaggagggaaggacagcugucuauggaaccaaucucgcauguuaugugauuguaggguuugaggaaggagaagccacaggugcacugauuagaguuccggggaauagcuacucuauuaccacuucuauuuuaguucaagagauacaacaagaacaaaagauaguauacauauacacaguauauguaccaaaccauuaaaauaagugacauuuggaaccugguugggcuacagaguuuuguggcagcugcuuuuuuguuguuguuuuuuugagacagagucucgcuaugucacccaggcuguagugcaguggugcaaucuuggcucacugcacccucugccuccuggauucaagcaauuauccugccucagccuccagaguagcugggauuauggaugcccaccaccaugccccgcuaguuuuuguauuuuuuuuuuuuuuuuaguagagacaggguuucaccauguuggucaggcuggucucaaacuccugaccucgugauccacccuccucggcgucccaaagugcuaggauuacaggcgugagccaccgcgccaggcccuuuuuuuuuuuuuuuuuuuuuuuuucagagagucucacugucacccaagcuggagugcagugguguggucuuggcucacugcauccucugccuccuggguucaagcgauucuccugccucagcguccugaguagcugagauuacaggcaugcaccaccauacccagcuaauuuuuguauuuuuaguagggaugggguuucgccaugcuguccaggcuggucucaaacuccugacuucaagugauccaccugccccugccucccaaagugcugggauuacaggcaagagccacugcgcccggccggcagcugcuuuuuaacagaggaauuccaguccccugggagcaacaggagcucagugaaauuccagggacuuccaucccagccccugccccugccccuggagcuccaaauccuccacuuuauuggaaaaucggcccccagcuccaaacaccugcuacgaauuaccaugcacuaaucuaaggcugcucaaguucugagaacuccacccaggauccaaacaaaaacaaaaugaugcaaugaggaggaaauacaugccgccugaaccaaggaccccugggcacagccugcccugcccugagccaggagucccaggaaagaggccccagaccccaugggaagaggggcugcagcuggggugccauugucucagcgcccacagcagguguucuggugacagaucccuaacacagccacucgcuagcacgaugucugagcucaggguaaauggugcaucuguucacggcuagauaacuuggagggaguccugcucuaaagcggcggacggagucugcugacugcggcuccacugcuguggcugcuguuguuuuaagacacucugaaauccuggcggagugucccaggugggaagugcacaaauccuuccaauccaugcucucuccuuacgcuuuugccaggagcucucagggaaggauuuguccgaggucacagggcaaguggcagaaccaagaauagaacucagaacacugggucugagacacgcagagcugccugcaggaagugcccuggugcucucaccucagcacagaaacacacacagagagaggaggcgaagcuuggacugggggcugcggcucccugcccgcuguccccgcccacagccccccucuuucaacugcacauuuuaaaggcuucaugaagaacccgaaguggaaaccccaacaugcugcccugaauuguccauacccuggggggcucugaggcccccacgugucaccauguagucuucagacuccuuaccagagcuggugagggugacgccguucaccguccccuccacaucugucucguccucggcguagcucaggaucaggcucugcugccggcucguuagccuccuguggaccgagcagagucagcagccaaggcuuccgccgggaagcuuuggaaagaacucacaggcagccagcacccucgcagcacaugggaagagagggacccaaccuuggcaggggcggacacccugagccagugcagcggugagaaccuaaggaccaugcccucaaagcuucuguacagaaaagcuccuaaaacacccuacacuaagucauuuaaacaagugucacuguggcuaugcuaaauacaguuuacaggaggggaaacagauuuuaccaguguguaugugaagcaaguaagaaauuaucuaauuaggccaggcgcaguggcucaugccuguaaucccagcauuuugggaggccaaggugggcggaucacaaggucaggagauagagaccauccuggccaacaaggugaaaccccgucucuacugaaaauacaaaaauuagcugggcguggcggcacaugccuauagucccagcuacuugggaggcugaggcaggagaauugcuuaaaucugggagguggagauugcaccacugaacuccaccuagagacagagcuagacaccaucucaaaaaaaaaaaaagaaauuaucuaauuaacaaaaagcaugagugcucccgaggggagucaggcaugucccgcccuagguacccacagcacucugcccaggccaccucuccagcuccuaacagugcuaguaacaucaacaagaaaagcaacgggccaggcgugcuggcucacaccuguaaucccaccacuuugggaagucaaggugggcagaucaccugaggucaggaguucgagauuagccuggccagugaaacuccgucucuacuaaaaauacaaaaauuagcugggcguggugguaagcgccuguagucccagcuacucgggaggcugaggcaggagaaucauuugaacuggggaggaggagguugcagugagcugaaauggcaccaccacauuccagccugggcaacacagugacagauuccuucucaaaaaaaaaagaagaaaaucaacaauagcagcagcagcaaagcaauuccuauguguuguucauuuaauucucccaacaacuccaagaagucgaccauucuggccgggcaugguggcucacgccuguaaucccaacacuuugggaggccaagguggguggaucacuaggucaggagauugaggccacucuggcuaacacggugaaaccccaucucuacuaaaaauacaaaaaauuagccgggcaugguggcaggcaccuguaaucccagcuacucgggaggcugaggcaggagaaucgcuugaaccugggaagcggagguugcagugagccgagauggcgccacugcacuccagccugggggacacagcgagacuccaucucaaaaaaaaagaaguugaccauucuacuauguccacuuuacagacagauaacucgggcaggaaccaccugacuuacagggagcaguaaccugcccaagccacagagcuccaagggcagugccaccgcaggaccaggcgggcuuggccacagccuagggggcacuuacuuuggaacucguaucuugauguggauguaguggucuccguagccguagcuguuaauccgggggaugccuuucccacccauccgaaucuucuggucugucugagucccaggggggaucuauaaagaaagaaaaucugugguuuccccugguccccaguugcucaaauaaaaaguuuucacuacaugaagacaaucuugauaggaauuccuugaaaagaacuaccacuggcucacgcucccaucacuuugggaggucgaggcaggcugaucacgaggucaggaguucaagaccugccuggccaacaugaugaaaccccgucucuacuaaaaauacaaaaaucagcagggcaugguaacgugcaccuguaaucucagcuacucaggaggcugagguaggagaauugcuugaacccgggaggcggagguugcagugagccaagauugugccauugcacuccagcucuggcugacagagcaagacucugucucggcagagcggugguggaggggguggguaaaaaaaaaggccgggcgcaguggcucaugccuguaaucccagcacuuuggggggcugaggcaggcagaucacgaggucaggugauugagaccuuccuggccaacauggugaaaccccaucgcuacuaaaauacaaaaaauuagccaggcaugguggcgcgugcuuguaggcccagguacucaggaggcugaggugggaaucgcuugaaccugggaggcggagauugccacgagccaagaucgcgcuacugcacuccagccuggcgacagagcaagacucugucucaaaaaaaaaaaaaaaaaaaaaaaagaacugccacugggcugggcgcaguggcucacgccuuuuaaucccagcacuuugggaggccgaggcgggugaacugccugagaucaggaguugaagaccagccugggaaauacggugaaacccugucucuacuaaaauacaaaaaauuagccaggugugguggcgugcaccugacgacaaagcgagacuccaucucaaaaaaaaaaaaagaaccaccacuuggguuucugggccaagcccgcccacaagcacauggaaaugagcuaaguugggucugcccagagcagagccugugacuaggaugagggggcaagaguuugggcaagugagcccaggaagcaggagugagggagcaaagcaggaaaagccaauacagggugcguggcugaggucgcucccuggcccuuggaaccacaggacccuggagaagccagggaauagcccccagauggaggagaaagccuuggcccaaaaugcccaccuccuucauggagguuaccccaagguuccccacaaagaagcuggagaagguucugaggcgaauacagagaaugauguggccuggaggugggaagagcuggaggggcaggucaagagagaggugggggacaggugcuggcagcacacaggcagccaucacuguggcaaaagggauaugcaccgcccgagucuucugcucuuggagccagacacuggacagaagcaagugcagagagcacaacccagggugaacccuucuguguccugaaugcgcccaguucccaggccccgcuaaccagugugggagugaugccagccaggaacugcuucccaugcgauuauagacucaaggccuguggcuugugguccacacucaaggagcagccuaaaauuccucauguccuccccugugagugcccccccacaugcuggucacucauggguuccaggccacuggucaguucuuuuccauuucagaaaaagagcaauaaaguacaggggugacaaagguguucucacacccucuuaccgucacguugaucgucucguacaggcccugggcucuggcuguacccccaagaagagccugagcuauagaaauaaagaggucggaguggaugucugcgccgucccuccggaacacagggcuuuucugcaccuaaggccaaacaugacagaugcaugugaagauaaguccacugcagacuaaacaccagcugcaugccuggccaggcccaagcucagaccugacaaacuacacaccccuuccauacauaaagugcaguguugagggaaagaacuguccuuccaacaaggagacaccaucccaggcccaggaaugacauguucuacauauuucaacacugcaauguucuacacacuugaaaugccgaaauggaagcgugccuggauuuccucagucucagaucaagccauucaaucgugaagggaaacaaaaauguaaaacuggcuuuugauuuuuuuuuuuuaaucuuacuuuagccaggcacaguggcacacaccuguaaucccagcacuuugggaggccaaggugaguggaucaccugaggucaggaguuugagaccagacugaccaacauggugaaaccuugucucuacuaaaaauacaaaaauuaaccaggugugguggcgggccccuguaaucccagcuacucaggaggcugaggcagaagauccacuugaaccugggagaugaaguuugcacugaacagagaucacaccacugcacuccagccugagcaacagagcgagacuccaccucaaaaaaaaaaaaaaaaaaaucuuacuuuauuagaaaguauaggccagccgugguggcucacgcuuguaaucccagcacuuuggaaggcuaagguggguggaucaccugaggucaggaauucgagaccagccugccaacauggugaaaccccaucucuacuaaaaauacaaaaauuaccuggguguaguggcgcaugccuguagucccagcuacucaggaggcugaggcaagagaaucgcuugaaccugggagguggagguugcagugagcugagaucaugccacugcacuccagacugggcaacagagcaagacucucuuuccagaaaaaaaaaagaaaaaaaagggaagaguaaauaauauaacaagcaugucauacccacaacccaguggagguaacaaaauaucacaggccgggcgcaguggcucauaccuguaaucccagcacuuugggaggccaagguggguggaucauuugagcccugggguuugagaccacccugggcaacauggugaaaccucaucuuuacuaaagauacaaaagucagccgggccugguggcgugugccuguagucccagcuacucaggaggcugaggugggaggaucaccugagcccagggagucugaggcuacagugagccaagacugccccacugcauuucauccuaggcaacaaagcaauaccccaccucaaaaaauaaaguaaaauaaaauaaaacaucauaaacaccggugagucuugcccuccucagcuaaccacaacccugacuuuaacauuuaucauuccuacaagcuucuacuuacuauguauuuccgugucccuaaauaauacauaaugccaucucacagguuuuaaaacuuuacacagauggucucugaggcccuacagccacuggcaagcugccuuccaucccugcugucuguaccugcaacgccuggagcaucccuugaguucagcucucauucuuuccuuccgacugcccugcagcagccucugaccaccacggcucacugagccauucucuuguuggaggaaggcagugucuugcuaccauggacaggacucuugugcaccccuuuguaccuaucgccugcuaggcuuguguggguuuuucucagguguacacauaggagggcaauugccaguagaaggcauugucuucauuaauguuuccaccaucucagaaaaccaagguuugccccuguauacaguauguaaaauuguaacuuucacacucacugccucaucaacaaucuuaucauaaaaacacaagauguuuccuguauuuuuaugugaccuguauuucuaacuuguuagcauguugaagaaguugucuucucuccacacaaggcacagaaucuugaagguaacaaacagcuaaaaaccacaucuagguggccacugugccccucagaaacaugaauggcgagacauguuccugugaagcuuugauuacaugggagcagccucagccacacccacccgaagagaggaaaggcccaacagaagcugugcggggcagggcaccuacccugaacguaaugaaaauuucccuuuuucccacaggcauccucacggucuggccauccucgacuccuacaagggacauuagaaagggagaaguuaggcaggacgcgguggcucacgccuguaaucccagcacuuugggaggccgaggcgggcagaucaugacgucaagagaucgagaccauccuggccaacauggugaaaccuggucucuacuaaaaauuaacugggcgugguggcacacgccuguagucccagcuacucaggaggcugaggaaagagaaucgcuugaacccaggaggcggagguugcagugagccgagaucacuccacuacacgccagccuggcaacagagcgagacuccgucuuaaaaaaaaaaaaaaaaagaaaagaaaaagaaaaaaaagaaagggagcaguuauugugagaccucccacagcacuuuccacccaagauccacuuguaacccacagcuucuuccccacuccuguuucuuauuaacgaggaacaaugucauuaucuaagaggcacauggguaaccuuccagagaugcaacacagacaccugaugacugagcaccugccucaggcuuggucuaggcaguaccucagggaguucauggucucacuggggugauggguguuaaccaaacgauagcacuaaugcauaacuacaaacagagacaugcucuucaauggaaaugcucacaacucuagagaaacagacaucuaaacaacaguaaagcaggccacgcgcgguggcucaugacuauaaucucagcacuuugggaagccgaggcggguggaucacgaggucaggagaucgagaccauccuggcuaacacgaugaaaccccgucucuacuaaaaauacaaaaaauuagcugggugugguggcaggugccuguagucccagcuccuugggaggcugaggcaggagaauggcaugagccugggaggcagagcuugcagugggccgagaucgggccacugcgcuccagccugggugacagagcgagacuccgucucaaaaaagaaaaaaaaaagaacagggaggagggugugaggcuagcuagggaagggauacucaagcugggaucuccaagaugaauaaaguuaaccgaaaaaagaaagcagaaagugaguuuugggcaagggaacaguagacauggagugaggggugggauccguggggcugauguagauaggguggcagcagggacaaugauggcuucggugacuaagacaggggagagaggagaggagcccggggguuggaagcugcucccucaccaggaagaagcagaguaggcacgucaggucucuucuccccauugugacaugcaaaguguaaauuuuaaggauaacuggcagaaacagaaagauucaaggagacuccaguuccuccuccagccuggggcuccagggccucaaccauaacuucuaccaagagcccacucacacucagugcaguggccucggcccuguccacccucuccacacggugugguagccucaacccugucugcccucuccaagcuccuggacauggcgggcccaagcacccaccugcaggcacagggaucaucacucgcuuuuucugcuuggcuuguccugcuccccugcagaccacacagggcgauaugaugauggagccgcggccaccacaucuccuacacguggaacgcaucacaaaagggccuguguugaugguuuccugauaaaaacaagaaaaaugguaaccuaaguacgcagguaaacugaugggugguucugggaccacaaugugcguaagaaaaaugucucuuuaaggcuuguuuuuuaugugcaugugcacucaaacacacugccuaggaacccaggugcagggccucaaucuguucaucugauuuucuagaacacacaaacuucugcacuccagaucaucaacuugaccacacgacacugaaaaauaugauaccgccugucuacagaaguaccugaagacuccugggagcugaacaguacauuuaaaaaagauuauuuccccuugaauuaccaaagcaauuguuagaaaaauaaagaagaaagugacaacuggaugcaaucccccgccccgcccccggagcugcugugcucugguugcugagccugugguaucagggaaagaggagcacaggcucgucuccucagggucacgggggaaagacagccaggcugaguucaccaacucccccaauucccagcauacguucucugggagcagugccacaaccagcucuucucagucaguggugcaagccgugggagguggagucucgggcagagccuuaccaugccggagccgccacaguaguggcaaugcugcaccuuggugccgggcucguuccccuugccguugcagcgcucacacguguccaugauguucacggugaacuccuuguugacccccuuugcagcuugauugaaugucaacuccaugaaguacuaaagaaaccaagggacagccugucaacuuuuguuugcaacgaccaaaacugacgcucggcucuaaagggaaaggaggguacuggcccacauuuucagucacucuuucaccacuguacuuacuugcacucugccaaguaagcauagguaggacucacugaacgaauucugcccuacucuuugggauuuuuaagagauaauguaugacuuaaaugaaaacguacuuucaacagacugaaaauguucacagauaaauacucguacauggcacuuaaaaacagccugaaugauccacaaucauaauuuagaucauaaauauauccccucucucuuccacucugacagugucuuauaaggacauaaaugagagaggaucagcagugccuucccaccggacagaacucuccuggaauacuguagcagaugagagacaacacucacacccucaugggcucugaaagccuuaggugcuaccucauuaugcaacuguuaagaauaccaucagaauggacauacucauuacuaccuaugcgauuuuucaaauacugaaauuauuuucuacuaaaauggcugccuccagaucacuccauuuaagcugccuugccuuucugagaaacagaaacugauaaaaaaauuuguuugacccauacuuagucuaaaauuugaauaauucuuccaagugaggaacuuacuuccugaggcugaucaaacacggucuggaaaucuccaaaugaagaggaugagaacucgccaaagaucuuccugaacagcuccucgggguccacaguggggccucccuuccaguagcuaugcugggagccgcuggccccaggaucgaagccugcagagccguaggcaucguacugcuuccucuucaccucaucacucaaaaccuacagugaaaggcagagccacugggcaucccaggucuaccaaggcccaggaauacagacaagaguucacagcaaauaaggcagccauaacauuuauuaaguggcccugugugcaaacacauccuaugagguuggggugggccugugacuagcaccuagaagagggaugagaugaccaaacugaaugcuaaguguagggcgugaagugcuuccaaaagucucacgaacucucccgccgucgcgcaugcugggaaaauguuuguguugauccucgcuugaccucacaggcacccuggauucuucacagauucacacuucaccucucuccucaggggacauuaccucguagagaauuuaugcuuccuacccuuaccuucaucgaaagguuuucugcaagccagaacaaccggaguaacagaaguaacagcaacgacaauagcaguggugcaauccuagcucacugcagccucaaccucccagguugaagcaauccuccugccucagccuccacaguagcugggucuacaggugcacaccaccaguccuggcaaauuguuuuaaguuuuuguagagacagggucuugcuauguugcccaggcugcuuucaaacuccuggccucaagcgauccucccacuucgaccucccaaaauacugggauuacaggcaugagccacugggccuggcccacaaaacuguuaauaaggacuaacuaccucaaaaagggggauuagggagggacaaggaaaaauguaguauucacuuuguaucuuuuuuuuuuuuuuugagacgggagucuugcucugucgccaggcuggagugcaguggcgcgaucucggcucacugcaaccucugccucucggguucaagugauucuccugccucagccucccgaguaguugggacuaaagacaugcaccaccacgcccagcuaauuuuuuuguauuuuuaguagagacaggguuucaccacguuugccaggauggucucgaucucuugaccucgugauccgucugccucagccucccaaagugcugggauuacaagcgugagccaccgugccuggcccucacuuuguaucuuuuuuuuauguguuugucuuacuuuuuuuuucuuuaauuaaaaagacacugcccuaggcugaguaugguggcucacaccuguaaucccaggacuuugggaggccaaggcagguggacugcuugaguucaugaguucaagaccagccugggcaacauggugaaaccccaucacaagaaaaauacaaaaaaauuaaccaagaaugguggugcacgccuauaguuccagcuacuugggaggcugaggugggaggauugcuugagcacggagguugagguugaggcugcagugaaccgugauugcaccauugcacuccagccugggcaacaaagugagacacuaucucaaaaaaauaggcacuauccuuaaggccaaacagaaaagaguacgcuuccuccaaaggaaaagacacuuccaccuagaauggagggggacuaagaaagcagguggaggacagcuuggugccuaggguaacuuuuagggcacccaguuaagaugcaaaggaggaaggcuggcagaggaggagucaggugggaguucaugacuuccugguggguuuuaucuccugguuccagcccuucccaaggaauugcugcucuuagguucugaggcucgguccguuuaauaacaucccccuugaagacagaagucagcaacacgguggauuaggacucuccaaaacucaugccccuggcagaaacaucagaucaacuaaccauguggaaaaacacauucacaagaauaacacccccccgccccauuaaaaauugaaucuucugggugcaguggggaaccuguagucccagcuacucaggaaguugagguugaggcaggaaaacugcuugagcccaagaguuugagacugcagugagcugugaucucgccacuacacuccagccuagguaacagagugagaccucaacucuuuuuuuuuuuuuuuugauugggagucucgcucuguugcccaggcuggaguacaauggcgcaaucuucggcucacugaugccucccggguucaagcaauucuccugccucagccuccugaauagcugggauuacaggcacccaccaccacaccuggcuaauuuuuguauuuuuaguagagaugggguuucaccauauugcucaggcuggucucuuggccaggcuggucucaaacuccugaccuccugaucugccugucuuggccucccaaagugcugggauuauagggauuauagacguaagccacugcaccuggcugagaccucaacucuugaaaaaaaaaaaaaaauuaaucuuaucuuccauagaagcagguuccaagacuguuuaguuauguuaucaauuaguuugaguuaccuaauaagaacauauuauuuuaaaauuacacuaguaaauaaacuuuucauuagaucuaguugacagauauuuacucaaaaaagauuuacugaguugagccuguucuucuacguggcugucuacucuuauagauauaugagcuccuauauauacugaaccccuuuaggauggccaaagucgggcaggucuggugccuugcaccuauaauccuagcaauuugagaggcugaggcaggaggaucucuucagcucaggaguucaagaccagccugggcaacauagagggacccugucucuuaagcaaaaaaaaaaaaaaaaaaagaaaagauugucaaaaaaucugggaaaaaggucuacuuucagaaaacuauggaaguggggucaauagcuguuuucagagauguaugcuuuguccucugauuacauugacauucuuauaggacaauaaugggcuucuacuuuuacaauaaccucuauccccaaaaagcagugaugcccugagguggaggaaggggaugucauugaauaagggcugaauuaauuaauccaacugugaauucccaaauccagcuacaaguguaaauuaccuggggaacuuuauuaguacagauuauuggauccuguucuuuuuuuuuuuuuugagacggggucuugcucugucgcccaggcuggagugcaguggcgcaaucucagcucacugcaagcuccgccucccggguucacgccauucuccugccucagccuccccagcaccugggacuacaggcgcaugccgccaugcccggcuaauuuuuuuuuauuuuuaguagagacgggguuucaccguguuagccgggauggucucgaucuccugaccuggugauccaccugccucggccucccaaaguguugggauuacaggcaugagccaccacgccuggccuggauccuguucuucauugagauuccaaguuagucuuagaauguuguuguuuuguuuuuuuuuuaauuuuuuauuuuuugagagaaggucuuuuucuguugcccagaccauaguucuauggcacaaucauggcaucaugggucacugcagcuuugagccccucaagugaugaaccugacucagccucccaaguagcuggguuuacaggugcgccaccaccacgccuggugauuuuuuuuuuuuuuuuuguagagacguggucuuacuacauugcccaagcuggucucaaacuccuagggucaagccaacuccugaggucaagugauccuccugccucagcuucccaaagugcuaggacuacaggagugagccaccaugcuuggccuggaaucucuuuuuuuuuauuuuucuuaacaagauuacuuggcgcagggacauggccuucacacuggacuguaugacacaccaggcugucccagguagcaaugcaaccuuugauucauacacauagcugaacagcagugaccgcaugcaccgaagucauauuaccucauaggcuucugccagcugggagaacuucuccuuggcuuugggaucauccuuauuugugucagggugauacuucuuggcaagcuaagggaaaaacaugauaaauuacuccagauacaaugugaaccccaaauaccagaaacaacaaaacccccgauacaacagaaccccaaauaccagucauaauuauguucccuuuauaaaaguugucucucggcugggugcaguggcucacgccuguaaucccaacacuuugggaagugaaggcaggcagaucacuuaagcucaggaguucaacaccagccugggcaacacagcgaaaccccucuccaccaaaaauagaaaaaauuagucaggcgugguggcacaugccuguggucccagcuacucaggaggcugaagcacgagaaucacuugaaccugggagguggagguugcagugagcagagaucgaggcacugcacuccagccuaggugacggagugagauucuguccgccccacaaaauaauaauaauaaugaucuguuuuaauguauccaucucuuaacuugagggcaggaacugauucugauguaucuuugcccuuagcacccagcauggcuuagaauagguaaaugaacaaaaaagaaaaacaaauuuuuaaaaagggggccgggcgcaguggcucaugccuguuaucccagcacuuugagaugcugagcuggguggaucaccagaggucaggaguuugagaacagccuggccaacauggcgaaaccccaucucuacuaaaaauacaaaaauuagccagguauggucacacgcgccuauaaacacagguacucgggaggcugaggcaggagaauugcuugagcccaggagacagagguugcagugagccaagacugcaccacugcacuccagccugagccacacggcgagacucugucugaaaaaagaaaaaauuuuuaaaaagggaagaaaaugacugaauaaauagacgucucugcuguuucaauuauuuuuguagguaaauaaaauacaguaauugcuacagcuuuaccugaucuuuuuacuuccgugccuaaaaaucugaaugguucucuaaauuaagucuuucucuuaaauuaugucucugggacuuacuaagggccucaaaucaacugucaugugaguccaacccagccuccaucuuuucaaucuuuucccacucuuggaucaggcaccugacucuugagcucaggaagagacaggccauucgcucuucacaggccaggaucucugcuuccuguccccaugccucuguucauuccauuacaacccaauuaaaaaaaaaagacaacccaguuaaaagugggcaauggauccaaacacacguuucuccaaagacauacuaauagccaacaugcacaagaaagaugcucaccaucauuagucaucagggaaaaagcaaaucgaaacucuaacgagauagcauuucuuauucacuagggucguaauuaaaaagacagacgauaauaguuaaguguucacugggauguggagaaaucauggcccucauaugcugcuggugggaauguaaaauggugcagcugcuuugaaaaaggcuggcagcuucucaaaagguuaaacauccaguuaccauaugacucagcaacuauacuccuaaauauccaagagaacugaaaacaugucuacacaaaaacuuacauaugaaugucuauauagcagcacuguucaugauagcaaaaaguggaaaauauccaaauguccaucaaacgaugaauaaacaaaaugugauuaauccaugcaacagauuauuugaccauaaaaagggaugaaguauugacacaaacuauaacacagaugaacccugaaaacauuaugugaaugaaagaagccaagacacacaaaaggauacauauuguaugauucccuguauaugaauauugagaauaggcaaauccaaagaggcaggacgcagauuagcagcugcuagggaccggggagagaggacaauggaaggggagugcuaaugaauacagaguuucuuuucgagguaaugaaaauguccuaaaguugacuguggugacaggugcacaacuccagugaacugugcacuuauaaaaagcugucaauccuacaauggugccuccaauauugauuuuauuuuguuggucagagcaaaccaagggucuaggaaccagugguguagacaucucguauacaacuuuacucagcuacccuaacuacccuaauagacccugggauacaaugggaauuucacauuuuccagguuaagaaagggccaggcgcgguggcucacgccuguaaucccagcacuuugggaggcugaggcagguggaucaccugaggucaggaguuuaagaccagccugaccaacaaagugaaaccgcgucucuacuaaaaauacaaaaaaaauuagccgggugugguggcaggugccuauagucccagcuacuugggaggcggacacaggagaacugcuugaacccaggaggcagagguugcagugagccaagauugcgccacugcacuccagccucagcaauggagugagacuccaucucaaaaaaaaaaaaaaaaaaaaaaaaaaaagaaaggaaaggaaguaauucuaaaccucuaaacuuuuaucuggaugcaaaaaauaacuaccuaaaacuuagacuagcauaucuacugauucagaaaauacagauuaaauuuaauuaugaaaacagcucuagaaaaaaaaacuucuuaaaaucucugguuuggacucaccucuuuuuucugaagcaccaaccucuacagcauugugcaucgaaaaacagucuagcaaaguccagcuuuaucacacccuucuauacuaucagcucaugagaccuauucauaugggcacauacgcuguacugaucaggaucacaugggaucaacaacauuccuacuacaauuuggucaccaaaaccugacuuccauacagaccugauaauaggcuuucuugaucucuuucuggcuggcauuucgaggcacuccuaauaucugauaauaaucuucuuuggccaaaggggcacucguguggaaggaggcaguacaaaugaaaggguuauguuuuguuccuaaaaaggaaaaaacaaagaaaaucacucugggaauguucucaacaaaagaaaacugugaguacaugacccaccaggcuauaucugugaaggaacaaacaaacugauaagguuuggcuguguccccacccagaucucaacuagaauuuuaguucccauaauccccacgugucaugggagggaccugaugggagguaacugaaucacaggagcgguuaccuccaugcuggucucgcgauaguaaguucucaugagaucugauaguuuuaugaggggcucacccuuuugcucauucuuccugcugccauguuaagaaggauguguuugcuuccccuuccgccacgaucgcugaggccuccccagccgugcugaacugugaguuaaauaaaccucuuuccuuuaaaauuuacccagucuuagguaugucuuuauuagcugcaugagaacagacuaauacacaggcuacagcuuuagggcuguucccuaaugcacuucaauaauggcuaaggaagccacaguauucaauuaauauuaaacuaugucagaguauuggaugaggcugauucuccucgcuuauacuacuggaguggucucaguaaaccacuaaaggaauaauacuccugacugggagaugauuaaaaagggauucagcuccccccucuuaugccacaugagcacuuaccauuugcuagguauuuucauauuuucauauuuuucugucacauuuaaugcuuaacaacuccccacauucuuuucccucuaucuugcagccuuggguaucuacuuaaggagcaguucucaagacugcgcucccuggaccaacagcaucauuagacugaugaaaacacagauguucaagcccuacuccagacauucaccagaaacucaggaggucuccacccacuagaugccaguagagaacuccccgucuccaggcauugccaaauguccccugggaaguaaaaguguccccugcugagaaccaaugacaaaucaaucuaagaaggucggggaagaacuucuaggcaucagcuguuaagcugcagaaacuggcuaagcugcccaggaaagcauuugccacuuucaguggaaaacaaauggcgguuacuaacuaggaugacuuuguacuuuggaucuggauucacagcaccuuuuuuaauagcaagacaccaacugcuuaagaaacaaggauguuuuaguucauccacuuaacagauaggaagagcagguuuuuuguuuuuugagauggagucucgcucugucgcccaggcuggagugcaguggcgccauccuggcucacugcaagcuccacuucccggguucacgccauucuccugccucagccucccaaguagcugggacuacgggcgccugccaccacacucggcuaauuuuuucauauuuuuaguagagacgggguuucgccguguuagccaggauggucucgaucuccugaccucaugauccgccugccucgaccucccaaagugcugggauuaccggcgugagccaccgugcccggcaggcuuuuuguuucuuuguuuuuugagacggaguuucgcucuucuugcccagacuggcgugcaguggugcgauuuuggcucacugcaaccuccgccugcuggguucaagcgacucuccugccucagccucccaaguaacugggacuacaggcgugugccaccacgcccagacuggagguguuuuaauagaugaaaucuguuuaaaaagugaauaagccgggccggguaugguggcuccugccuguaaucccagcacuuugggaggccaaggcgggcggaucaccugaggucaggaguuagagaccagccugaccaacauggagaaaccccaucucuacuaaaaauacaaaauuagccggauguggugguacaugccuguaaucccagcuaguaaggaggcugaagcaagagaaucgcuugaaccuggggggcagagguugcagugagccaagaucgcgccauugcacuccagccugggcaacaggagugaaacuccaucacagaaaaaaaaaagaaaaaaaaaaagaaagaaaaauaagccugggcacaguggcucucgccuguaaucccagcacuuugggaaccugaggcgugaggaucgcuugagcccaggaguucgaaaccagccugggcaacacagagacccugucucuauuaaaaauaaauaaauaaauggaucaaagacuugaacuuauaugacauacuagauguuuguaaauaaacuuaugacauggaaaaaaaagagagagagacagaaauaggcuaaagaggacuuugaauccauacagauuuauaccuauaacuaaacuagauggcaguggugguaguggugguuagagaugauaacgauuaauggggccuaggaauaggaagggccuuagagcuaugcuaaggagucuggauuuuauccuaagagcaauagggagccacugcaaauguuaaacaaagaacccauuagguuugcaugagaaacaacucuaggccaggcaagguggcucacgccuauuguaaucccagcacuuugggaggccgaggcggguggaucacuugaggucaggaguucgagaccaagcuggccaacauggugaaaucuugucucuacuaaaaauacaaaaauuagccggucaugguggugcacgccuguaaucccagcuacuugggaggcugaggcaugagaauuguuugaaccugggaggcugagguugcagugagccaagaucgcgccauugcacuccagccugggcgacagagcaagacuccaccugaaaaaaaaaaaagagaaacaacucuaggaagccugggagacuacucgaaguuaaucagcacaaaacacaaccagagguugguugagcacauccaaguaggaggccagguaaaggaugaucagacaggagaauggauaggaauggucaggauacuuaaaauuagaaauaggaaauaaauccguguguuuggcacacccaauauccucgggauacaaaaagcacacuggaaguaguaggggucaggagaccacuuuguguuucuucagucagacuugagaaaacacuagaccugacuuauuauugaacuuguacucaacccucuuuuuauuucggaguaagggguugcccggcccaguccagccucucucucaccacucauuccaaugccacaaggcggaggcugguagugaccuguggcagcuguggcuucaacauuacgggcagagaacacggacaggaguuaguacagagauaguaacgcacaaaacugcauguggauaaagacaaaucacguuuaauuacaagacugauggcuuuguuuuuucuuuuuuugagacagagucucacucugucacccaggcuggagugcaguggugugaucucgguucacugcaaccuccaucucccagguucgagcgauucuucugcuuuagccucucaaguagccaggacuauaggcgcacaccaccacaccuggcuaauuuuuguauuuuuaguagguaagaaguuucaccauguuggccaggcuggucucgaacuccugaccucaagugauccgccggccucauccuaccaaagugcugggguuacaggcaugagccaccauccccagucugaugacuuuugacauuauccauagggcaucaaugauuaacaauaauuagauuucauuuaauagacuauuuauuuuaucacauaugaccaguaaauguccuguccuuuuuagaacaacccagaauaaaauaagccuccaagucguucuaagaauggccaacccacuguccaacaacugcuuucuuuuuuuuuuuuuuugacagggaguuuggcucuuguugcccaggcuggagggcaguggcgcgaucucggcucacugcaaccucugccuccuggguucaagcgauucuccugucucagccucccgaguagcugggauuacaggaacccgccaccacgccugaccaacuuuuucuauuuuuaguagagacaagcuuuggccaucuuggccaggcuggucucaaacuccugaccucaggcgaucaacccaccucccaaaguaaugggauugcaggcaugagccaccauaccuggccaccaacaacugcuuucuuucugcuuggaagaaaagucacaucuaaaauguuguuaugucaucuuacuacuagauuugagacaagaucacagacuaguguuuggacgcugaguuaaugaccuuuucaaaauuuuuuuuuuuaagagacaggggucucauuauguugccuaggccaaauucaaauuccuggacuccagcaauccucccaccucaaccuccugaguagcuaggacuauagaggcucgccaccacauggcuucucaguugaugacuuuauuaauuuuuugguagagaaagagucauacucuguugcccaggcuggagugcaguggcaucaucauggcucacugcagccucaaccuucugggcucaagugaaacucccaccucagccucccaagcagcugggaguacaggcaguugccaccauaguuggcuaauuuuuuuuuuuuugagacacaguuucgcucuuguugaucaggcuggagugcaauggcgcuaacucggcucacggcaaccuccgacuuucacguucaagcaauucuccugccccagccucccgaguacccggguuuacaggcaugcgccaccaggccuggcuaauuuuguauuuuuuguagagacgggguuucuccauguugaucaggcuggucucaaacuccugacuucaggugauccgcccgcauaggccucccaaagugcugggauuacaggcgugagccaccauguccggccacagucagcuaauuuuuaaaaaucuuuuuguaggccgggcgcggugacucacaccuguaaucccagcacuuuaggaggcugagguggacagaucauggguaaagagaucgagaccauccuggccaauauggugaaauccaguaucugcuaaaaauacaaaaauuaacugggagugguggcacgugccuguagucccagcuacucaggagacugaggcaagaggaucacuugaacccaggaagcggaggaugcggugagccgagaucacggugagucaagaucauggugagccgagaucgcaccacugcacuccagccuggcuacagagcaagacuccgucucaaacaaacaaacaaaaaaaaucuuggccgggcgcgguggcucacaccuguaaucccagcacuuugggaggcggaggcggguggaucacgaggucaggagaucgagacguccuggcuaacacagugaaacuccaucucuacuaaaaauacaaaaaauuagcugggcgcgguugcaggugccuguagucccagcuacucgggaggcugaggcaggagaauggccugaacccgggaggcggaguuugcagugagccgagaucgugccacugcacuccagccugggcgacagagugagacuccgucucaaaaaaaaaaaaaaaaaaaaaaaaucuuuuuguagagaugggaucugccuauguugcccaggcuggucccaaacugcuaggcucaugugauccuccugccucagcgccagcauagcgcuggaauuacagucgugagccaccccgcccaaccaguugaugacucuaucugugaaaacagcacguacccugaaggaugccaccucucaccuguguacacuaccugauauaaaacuugcccauggcagguuaugagcucacuuggggaacaagacagcuaaccgcaguuccuuagucacagcuucacacaaagcuuaguguuuagugccuguuucucucuuucacauacacaauaauaacgagugcucccaaauuuguacagcuggaacaugaacaaauuuggcuuaauaaaacaagucaccuaaggauuaauauuugaaugaaaagaugcagccagauucuauuuaaaacaaccuugacauuagaaaauguuagcaagcucuaaaaauggccacuuuugcucauguugaaaaaucuagccuggcaugguggcacacaccuauaagcccagcaucuugggaggcugaagugagccaggaucacaucacugcaauuuggccugggcaacagagcaagaguccaucucaaaauaaaaauaaggccggucgcgguggcucaagccuguaauuccagcacuuugggaggcugaggcggguggaucacaaguucaggagaucgagaccaucuuggcuaacacggugaaacccugucucuacuaaaaauacaaaaaauuagcugggcgugguggcgggcgccuguagucccagcuacucagaaggcugaggcaggagaauggcgugaacccgggaggcggagcuugcagugagcugagauagcgccacugcacuccagccugggcaacacagcgagacuccgucucaaaaaaaaaaaaaauucauucuguuggccaggugcaguggcugaugccuguaaccccagcacuuugggaagcugaagcaagggaaucacuuuagcccagccuggguaacauggugaaaccccaucuacagaaaacuagcugggugugguggugcaugccuguagucccagcuacucaggaggcugaggauggaggaucgauugaaccugggaggucaagguugcacugaguuguaauugugccucugcaccagucugggcaacaggaggcccugucuuaaaaaauaauuaaauacauaaauaaucauucucuuaaccaaacacacauccaaucucuuuguucucugccaucuccucagugcccagaacaguggcuggcauacaauuggccucaauuaacaccugugaaugaaugaauuuucagacaggugcucgaagggguuaaauaauacaccccgcucacagacgcuggggaaguucaccccugaagcccaggcucuuuucuuuacauugcaugaaguaaccacaauuacugauacuuuaaugauugucuacuauguaacuauuacaaacuggauugcaacaggaaguuaguugguauaaauuaucuugucagggcccuuuaauuaaucuuuauaaauuuauagauagcuuaaauaccauuugcacaaauucuagaggacacaaaacuagcacaauucagguacguacaacacacagcacaaaacacacggcauaagaaaagaaggcuaagcagggcacggugguucacgccuguaaucccagcacuuugggaagccaaggggaggcggaucaccugaggucuggaguuugagaccagccuggccaacauggcgaaaucccgucucuauuaaagauacaaaaauuggccaggcgugguggcgcaugccucuaguuccagcuacuggggaggcugaggcaggauaaucucuugaacccaggagucggagguugcagugagucgagauugagccacugcacuccggccugggcaacagagcaagauucaguuucaaaaaaaaaaagaaaagaaaagaaaagaaaacaugacuaagcacuucaaggcuuaauguauaauucagugucaucucaggcaaugauaucaagccuccaccuccuugugacauuuauaagugguuuaacaucuaagccucaguaucuuuauaaaauggaauaacagugccuaucauguggaaaugugauguaaggggaaaaccaugccuggccaacaguaagugcucaauaaaugucugacuguguuauuauuacaaucaccaacuaaagacuucuaaaaagauuguuaacugugcccuucaauuagcaccacgugguagaaagagcguaaacuaugacaugacugcuuuggguuugagacaacucuucuagucuaacuccaugaccuugggcuggucgauuccuccguugaaucucaguuucucauucuuuaaaauggugaugacggcaggcaucuugcaggguuguuguaacaaaguaccuaggccucuccgaauggcaguuagcucuucccuuccgcuacgggcuagaagguggagagaugggaaaggaagaggacgagggagcagcggccuccagaaauguugacagagaggugaagguucacgaucuacggggcguuucaucaccgccgccgggggcuccacgcuucucucccuuccuugacggcugagcagccacuggggccuccccgccuccugccugucugugucuccggcaauugugcauccgcgucggaagacacccuccaccccacuaccccugcagccguagucacagcgaggagacucacucuuuucuaggcccugaaaccgccacucggaaguuggaaccugcccucaccuguaaggcugacaccaggucucaaugucagcagcgcucgggggccgcaagaggucagggaagacgcaaaggcggggacgcucagcuugcggcucagccaugcccccaccacgcccucccugggcggccgggccccucuacccgauauagccggcagccgcgggguccccacaaccaccagcaaccagcguguggagcaccgcgcagccaucuuggcccggggacucugcgccugcgccgcccggcucuaggugggccucgcgggaacggcgggcgcgcguagaggcg

SEQ ID NO: 193041 - RNA, 51340 nt, Homo sapiens
ugaaauuucugaaucaaauuuaauuucuuuuaucaucaaaaguuaagacauauuucccucagucuuaggaauuuuuauuguuaauacaaaauaaauuauacaugcuguauaaauuuuuauuuauagcuaaauauuucuucagucaucacugucacuuccugauucacucagcugcaaaucauuuccuaaaauaagaaagaaauaacaaaacuguaguaauuaaauauuuaauauuauuuuugcauaacacaaauuuuacacaaaauauagcccccaagcgugauucuguuuaccuaguauuuugcuuauucuguaauucagugacacaauuaguaacucaaauaauacuguguguaaagaaaaaauauaccacuaaacuucagcaguuuuaguauuuccuggcaucuauuuuagucuucuuucacauauccccaucacucuuuuuuuuauaucacugauuuaauuaaaucgggaaaugagaaaaauguaguuuagaagauuaaacuauaucacuuugaagagugaaaaaaauguuauuuuuuuuuuacuuaaaauggagucaaaaucauuaaauaauauaugucaaggauaauucaccauugauucauuuuguaauucaucuauguacuuacagucauggagcuuacaguccagugggggagacagacaguaaacaaauaaacaaauauauaacauaaugccaaguagggauaagugcuauggaaaaaugaaaauggguauggagauggcaguggcaggugcuauuuuaaauaggguaguuuugaaggccuuuuugaggggugacauuugaacagagauccaaauauaggaagaaagucauaaaaaauggagaauguggaggugaagugaccaggccaaaagaacagaagugcaaaugccccaaggcaggagcauauuuguugcauucucugacuugcaagaaggccacuguggguggaauggaaugaauaaggaagauaacaguaguaaaugaggucagaaagauauccacaaggucaugguaaaaacuuuggauuuuguuugaaaauguaaugagaauucaugagaaaauuuuaagcaggcaacuaacuuaaaaccgguuguagaucaguaaauacgccauaaugguguggaagaaacacagaaacaagagagaaguuguaagucuaaugcagucucucauguaagaaauaauguuggcuuugacucagguagucugggggaggugaggcuaaguggucagauucauaauguacuuugaagacagaguuuauaggacuaauuaaaacauugaauuuaggguacaagagaaagaagugaagaaugaccccaagguuuuuguugugaacaacuggauaaaucauuuacugaguuaucauuuacugagaugagaaacaccagaggaacaugguuguagaagaaaaaucacaaguucaauuuucaugugguaaauuugagauaccuaguaaauacccaaauauauaugguacuggcaguuggauauacaagucuggagcuaaagguagaggcuggaccuagaaauaaagauuugagagucauugaucguacagguuuaucugaagcaaacagacugaaugaaaucacuuagguaguaaauuacaaugguuaaaaaaauucuuauauuuuuuaacuaauccgcaaucaaaaaagcuggcauguuuugaaaucaauaccuaauuuaagaagaauaguuuuuaggccacguauaaauuauaagauguuucagucuuuugcaugaacugcagaacugauaacaucauuugauaaagaaaucugcgaggucgggcacgcgguggcucacgccuguaaucccagcacuucgggaggcugaggugggcggaucaugaggucaagagauugagaccauccuggccaacauggugaaaccccgucucuacuaaaaauacaaaauuagcugggcaugguggcacaugccuguagucccagcuacucgggaggcugaggcaggagaaucacuugaaccuaggagguggagguugcaguaagccgagaucacgccacugcacuccagccuggcgacagagugaaacuccuucucaaaaaaaaaaauaaauaaauaaauaagaaaaucugcuaaaacuucuucugugcaucugguucucaugaccaucucaucacuuucauuucuuuuuuuuuuuuuuuuugagauggaguuucacucuugucacccaggcuagagcacaguggcgcuaucucagcucacugcacccucugccucccugguucaagugauucuccugccucagccucccgaguagcugggauuacaggcaugcgccaccaugccuggcuaauuuuuuuguauuuuuaguagagucaggguuucaccauguuggccaggcuggucucgaacuccugaucucaggugaaucaccugccuuggccucccaaagugcugagauuacaggcaugagccaccuugccugaugcauuucauaauuuucaaggauuaaguuuccacuuacagaacuauuauaugacauaagaauguuauaugaugccuguaauaugaguuuuucaagcgacacaaacccaaacguacucagaguuccauuuugccuuucuagacuuuaugcugucaagguuaggaaauauucagucaaguuuugaagauauaagauuagccuuugauuaugaguugcuuaguaaagaaaauauguuuucaaucauagcuguaauuaugacucagaaaaagagaguuuacccauagaaauauauucaggcauuuaaaucaauaguuaucacugagaguaguacugccccccaggggaugauacagaaauuuacaugagggguugcuuguccuguuggcuguagauugcuaauagcauuuagugggaggggaguuuaggaaugcuaaaugucuugcaauggaugaaccagucuugcacaauaaagaacucuucuacauucugugaaauuuuugaaagucggguggaauauguacuuggaagaucuguuuauaaauuuaaaaccagagcugaaauacauuuucauaaauuccaaguauuguuuugcacauauuuaauugaaacuuacaaguaugcagcuaucauguaaacugaagaugauuuuguuuuguauuuuuuaaaaacuuuucaaaaauuuucuuuuaaaaauaguuuggggcaacacauuaguaacaucaaugcugcucauuguauuuggagcagcaauacgcauaacaauaguugucuguauaggcagcuguagacgcaauuuuuuaauauauaugcauauacuuuucuaguccuuauuucuacagguuaaauaaaaagaaaaauuguugauaauaugaguugaauguuguuuuguuuuucuuaaauccaaaucuaugcauuaaaaguaacugcaaaaacaugguuacuucauuguaucuucugauauagcuauucuuuaacauuuacaaaguuagaacacauauuauuauaaauuuguuuuucuuuugccuuuauauuaaauuaaauuaaugcuuuucaaagauguauguacacagauuauauuaagcuaugaaauucauuucaaaauaguaaaggagaauuaaaaauaucuguuacaaaaggggguguugggucucauaaagcugagcaaugggaugauugcaguaauggucagagaugguuuauuucauuaggaaacuccuaguuuagauacaucaggaaaagaaauuucacuauuuuuacuuaaaaaaaaaaaaccaccaccucccaagugguuauuacugauagacaaaaacacuacggacuuuacuuucgcauauaucuuuugcaucuaguaaucuuuccaaauuauuuuauuaguucuaucguuugcugauucuuuuggauuuccuauguagauaauuuacauuccuacaaauuaagaguauuuuauuucuuguuuccaauucuuauaucauauuucuuuuacuuguuuuauuguauuugcuagcaaauucaauagagugcucaacagaaauaacauuaguccucuuugucuuguuccugaauuuaacgggaaugcuccuaaagucucuauuaguaugauguuuguaggaguucuguuuuuugguaauuaacuuuuauaaagcuaagaaaauccuauuauauucauccuuugguaaauguuuuuauuuauuuuacuuuuuuuuuuuuuuugagacagagucucacucugucccucaggcuggagugcagugacaugaucucagcuuacuguaaccuccaccuccuggguuugagcaauucucaugccucagccuccugaguagcugggauuauggguguguaccagcaugccuggcuaauuuuuguauuuuuaguagagacaggguuucaucauguugcucaggcuggucuugaacuccuggccucaagugacccaccugccucguccucccaaagugcugggauuacaagugugaacuaccaugcccagccucaaguacauguuuucaaauuaauaaauacugaauuuugucaaguuauucauuuguugaaaugaucauauggguuuacuucuauaaucuguuaauguggugaauuagauugauaccauuucauauguuuaacauuucuuacauuucugugaugacccuuauuugguugugauuugguaaauuauacuuuuucuacaaaaccauccguuccuaugucaaauuuacuggaauaaauuuuuuaauaaaauuauaauuaaggcugggugcauuggcucacaccugcaaucacggcacuuugggagacugagguggguggauugccugagcucaggaguucgagaccagccugggcaacacaaugaaaccccaucucuacuaaaauacaaaaaaauuagccggguguggcagcaugcgccuguaguaccagcuacuugggaggcugaggcagaagaauugcuugaaccugggaggcagagguugcagugaguugagauugugccacuggacuccagccugggcaacagaguaagacucugucuccaaaaaauaauaauaauaauacuaauuuuuuaaaaauaaccaauuggaaaaccuaaugauaauugauaaauuuguggacauauaccaccuaccaagauugaaccaagaaaaaauagaaaacaugaacaggucaaguacaaguaauaagacugaaucaguaauaaaaagucucccaucaaaaaaaaguucaggaccugauggcuucaauacugaauucuaccaaacauuuaaagaauaaauaccaauucuucucaaauucuuccggaaaacugaagaggugagaauucuuccaaacucauucuaugaggccagcauuacccuguuacugaaaccagacaaggacacaacuauaggucaaugucucugaugcaaauacaugcaaaaauccucaacaaauaguagcaaaccaaauccaacagcacauuaaaaggaucauucaccaugauaagugggauuuaucccagagauguaagaaugguucaacauacccaaaucaauaaaugugaaauaucacaccaacauaaugaaggacaaaaaccauaugauuaucucaauagaugcagaaaaagcauucgauaaaauucaacaucgcuuuaugauaaaaaacccucaacaaacuaggucuagaaggaguguaccucgacauaauaaaggccauauaagagaaacccacaguuaacauuauacuaaauggggaaaagccgaaagcuuuucuucuaggagcuggaacaauauaaggaugcgcacucucaccauucuuauuaaacgcagcacuggaaguccuagccagagcaaagaaacaagagagaaaaauaaaggguauccaaauugcaaaggaggaagucaaacugucccuguuugcaaaugacaaaaucuuauaaagagaaaacccuaaaagcuccacaaaaaacucaggauugauaaacaauuucaguaaaguugcaagauacaaaaaucaacauacaaaaauuauuggcauuucuauaaacaaacaagaagaaaucaagaaagcagcauucccauuuauaauagcuacacacacacacacacacacacacacacacacacacaccccaaaacacuaagguccaggacagugacucaugccuguauucucagugcuuuaggaggccaaggaaggaggacugccuggggccaggaguucaagaccagcuugcacaacacagugagacccagucucuauuaaaaaaaaaaaaaauuagcuggcaugguggugcacaccuauagucccagcaacuugggagccuggggagggaagaucacuugagccuaggaguucaaggcugcagugagcuguaaucaugccauuaccuuucagccugggcaacggagcaagacccugucuuuaauuaaaaaacaaaacaaaacaacaacaacagcaacaaaccuaggaauaaauuuaaccaagaaggugaaagagcuucacaaggaagacuauaaaacacugauuaaagaaauggaaguggucacaaaaaauggaaagacaugccauguucaaagauugaaagaauuauaaugugaaaauaacaauacuaccaaaagcaaucuacagauccaaugcaauaccuaucaaaauaccaaagacauucuucacagauacaaaaaaaacauaagcuucauauagaaccacagaugaugccaaauagccaaagcaacccugaacaaaaagaacauagcuggaggcaccacacuaccuaagaaaacagcaugguauuggcauaaaaauagacacacagaccaauggaacagaauagagaacccagagauaaauccacauauuuauagucaauugauuuuucacaaagucaccaagaacauucugugggggaaaggacagucucuucaauaaauggugcugagaaacugguuauccuuaaaaaaaaaaagaaagaaagaaagaaaagaaaagaaaaaaggaacuagacccccauuucucacuauaaacaaaaauaaaaucaaaauggauuaaagacucaauucuaagaccugaaacugugaaacuacuagaagaaaacauuggggaaacauucuaagagauuaaucugggccaagauuuuuuuguauguaagaccugaaaacacugacaacaaaaguaaaaguagacaagugggaucacaucaaacuaaaaagcuucugcacaacaaaagaaacaaucaauggaguaaagagacaaucuacagaaggggaaaaaauauuugcaaauuauccauccaacaagggauuaaaaaccagaauauauagaaauucaaacaacucaauggccaaagaacccccauauaauaccaauuaaaaaugcgcaaauaaacugaauagauuuuucucaaaagaaaacauuuaaaaucaauaauuuuaaaaaaugcccacaggcauaugaaaaaauacucaucaucacuauuagggaaaugcauaucaaaagcauaaugagacaucaucucaccccaguuaaaauggcuauuauugaaaagacaaaaauaacaugcugacaaggacacaaagggaaugcuugugggaauguaaauuaguacaggcacuauggagaacaguauggaggguccucaaaaaacuauauagaucuacuguaugcuccagcaaucucacugcuagguauauauccaaaagaaaggaacucaguauaucaaagugauaucugcaagccuauguuuauuacagcauuauucacaagagccaaaauauggaaucaaccaaaguguccauuaauggauuaauaaauaauuaauauacauagaauguuauucagacauaaaaaggaauggaaucuugucauuggcagcaguaugaauggaacuggaagucauuauguuaagugaaauaagccaggcacagaaagaaaaauaucauaugguuucacucacaugugagaguuaauaaagucuaucucauggagauagagaguagaaugaugguuaccagaggcucggaaaggugaagacaaggauaaacagagguugguuaguggguacaaaaauacaguuaaauaaauuuaauaaguucuaguguucaauagcacaguaggaugacuauaguuaacaacaauuuauuguauauuucaaaauagcuaaaagagaagauuugaaauguucuuaaccccccaaaaaggacaaauguuugagguaauguauauccuaauuauccagacuugaucacaacacauuguaugcugguaucaaaauaucacguguaagucauaaauauguauauuguauaucaauaauuuuuuaaaauauaguuauaauuuuaacuuaauuuucuuccuuaauauugucuauuugagauuuuucuauuuuucuucucagcccuuguuaaagauuggccuauucuauuggucuauuuuguuaguuuucaaagaaacaaauuuuuaguuuuguugauuuucuaauguuuccucauuaucuauuacauuaacuucuauucauccauauuauuuucuuucucugcuuuaagauguuauuguuuuucuaguaccucaaaaugaaccuuucacucauuuaucuucaauuuuuuuuaaauaacauuuugagguuauaaauuucccuauaaugagcuggacacaguggcauaugccugcaguacuagguacuggggaagcugaggcaggagaaucacuugagccccugaguucgaggcuguagugcaccauguuugcaccugugaaugaccacuacacuccagccugagaaacaaagcgagacuccaucucuaaaauaaaguuaaucaauuaauuaauuaauuaaauuuccuauucuccuuuaagacauuuccuuggaaguaccaaaacugcuauuuuauuuauuauuuauuauuuuuuaucuucauaacaguauucaauuuuuuaauguucaauuauaaauauuuuguaaucucauuauaguugccuuuuaacauguaaguuauuuggcaugugcuuugaaauuuaggucuaaacuuauuuuaaaguaauuuuuauuuauuuauauuuucauauuauaaucauaauauguucauuuaaaaagugaauucuuugaaaucuguuauugccuuuguccuaguaagagguaaauuucuguaaauguuucaaauguaccuuaaauaugaccacucacuuugcauuuuuggauuguaggauucuauguauucacuauuagaauagguaugucuauuauguauuuacagauuucauacccuuacugaauuuuuucugcuugauuacagauucauaaaaucucccacuaaaauagacuugucaacuucuacuacuucuguuauguuuuauacauacacacacacacacgcacacacacacauacauagugaagauauguuauuacaugcauacaaauucagaauuguuuaucuuccaggugaacugaacauuuucucauaauuuaccaagucccuuuaucucuaggaguacauuuugccuuaaaguguauuauuucugauauugaugauccagauuuuuguuauaauuacuacuuagcuagcaucuuuuuuucuaucucuuuauuuuccauaugguuuuuagacaauuuguuauaaucagcauauggcguuuuaaaaaaaucuaaucugauaaucuguuucuuauuagguggauauaaugcuuugcuuuuguuauuacugauauacugagauuuauuucuacuucauauuuucuguuuuggguugaucaaucacuuucuuucacuucuccuucucugcuuucuacuagauaaaguuuucuauguucccugguuuucccacugaugauguggaaacuauagauuguauuuauuaauuaaaugguacccuuaacauuuuaggauacauaacucacuacaaauuuaucuaauaaagucagauucaguguaucuauccuccuaacaugacauggaucucagcauacuuaaacuacugauugaauacucucucagcaacuauugucuagaguuuuagcuuuaaucuucaaaaaaaaauuuuccaaauguacaaacaucuaaaacagacuuguuaucuuuauagucaaagguuaaucaaauuuccugacauuuuaucuauuuuuuuguucacuacuguuucucauauuccacacuuuccuucuguuuucacuuuucuuucugcugaaauauauauauaacauauauauaugucuguuaauaauacauuugcuaaauucuacagacaauaagcuguuuucgugugccugaaaauuauuuuacucuugaaugacauuguguuuggguauaaaauucuagguagaauuauauuccuucaacacuugaaaaauauuucccccacuaucuuuuggcuuaccuaucuagcuaagagugucugcugucagacuauucuuuuguaguuugucuucucuguaguuuuuaagguuauuucauccuugauguuguguaguuucacuaucauguuuugaggucuagauuuauuuuuauuuacccugcuuauuagcugaaguaaaaauucauggguuucuucaauucuggaaaauucucaggauuaaguuuuuacacuaucuccuccauucuuucuuggacuuccuauuguguaauguuuagucuucucaaucuuuucuaucucuaagcuggucucucauuuuauuuuucugucucucuuguauuguguucugggauaguuccucaauauuaucuucuauuucaccaauuuauucaucaacuguauccagucuacaguuuuucuuauuuauugguuuuuuaaaaaugucaaugaccagucuaauuuauucuuuuuuauaaucuauuagauuuguuucauuucuuccuggcauuguuuuaucauucuuuuaaaagcuguaucuucauuuaucucuuugaauguuuuuagcguacuuauuuaaaugucuuugucuuaauugcucuguaaaaagauuuucauuuggaaagaaucccugcucuaacuguuaauuuuguuggcugacuuucuuagcauuagacuuuuuucuucuguuuuagaauuaaguuugcucauuuugaguggaaaauuucuguuuuucucuauccucacaccacucugacaggguuuuguaguucguuccaccuaguccucugagcuccauuaccagaaacagguuucauaaucacauuuggagauuguuauccucuggguauauuggagauaugcuagaucccuucaaggagucaacggauaucaagguucuacagacccuaugcccacaccuucuaaaacacaguagccucagucaauauguaaaugucuauuucuuccaaucucuuuuauuaauuggcuauuucuuccagucuccuuuuauuauuuauccccaccucuaucaacccucucucccuuuccccacuaccccucaacaacaugcauucucuagcuucaaauagaaaauaugacucagguucacugaaucagaacauuuaaacuauuaaaacuauuaaaaguucugauuauauuauuauaacuuucccugaaaguuaugauuauuucccuaaaaguuucccuaaaaguucucauuauauuauuauaccuuucccugaaaguucugauuauuucccuaaaaguuucccuaaaaguucucauuauauuauuauaccuuucccugaaaguaccaagauccuuaccaauaucaccuucuuuugaacucagauccaauggcuucagcuccacuaagcccacuguuuuguguuuauaguccaguucuucucuuuagagauguuuaucuuauauuugauucuggccaugucuggguuuuaccuuuuaauacuuuauccauuguuccuauuuguuuggcacagaagggguuuuaaaaacacaaauucacuaugcuauguuuuacuaaaaaacuauucuagauuuaaaaagaaauucuaaaauauaaaauauccugaaccccuucaaaguucuacaaggcaaugugaccucuacuuucaaugaggaaacugaaguuacaagaaaguuaaguguaguguuauuaguuacauagcuaauaagugauaaggaagucaggaauauaauacugauaugcugauuccuagacaggugcucaauuuacuauagaacuuauuaauuacuggaaaauuuuuucuagcuuuuacucagauucucauuuaguacaaccaagcugaguuuucuccauguucucuuggccauucaaaaaaucagauuuuccaauauuacuucccaagucaagaauaacacuaaauaacuggaaauucaaaguaucuuugcuggucccuaauuaacccauaguuuaccaauucucugccucucagucuuggcuucucccuucuuuaguucuauuauuaggcuaaagcuagucagucuuuccuagcugcuuacuuuuuucauuauuaauaaacauagugagauuaauuuuaaauauacagaaaauuccauucuccccagguaauaccaaccugcaugccuuuauuaaaaaguauuugcugagcaucuauuaugugucaaguaccaugugcuaagugcaagaauucaaugauaagcaaaaacaaacaagguccuuguucucauggaacauuauacucuagagaaagagagcaaaucacacaaauuaauguaaauuuacaacugucaaacaauugauauaaagaagacauaucugauauucuaaaggucuguaaaagauaggagcuuguggugaagcuucuuagcuucagaaaggugaagacuuucuagaggaaguaacuuugaacuauaaucuaaaggagaaaaaauuaugugaaaagaagaaaguguuucuggcugaauggacagcauguauaaggguccugaugugagugaaaguauuugaauauaguggcaaaaagaaagcacauguuguuagaaaagaaaaaucaagacgauuauguuaagguguuuugccucuauauuaaaagaaauuacaagcuauuaaaaaguauaaagcagaagagaugacaaauuguauuagaauugugaaaaaaaucaauauggcuacaguguacauaauggaucaaaaaugggcuugacuacauaaaggggugaaccaguuaggucauuguaguagguaaggcaagaaauaauagguugaacuacugugauagugguggagaugcagagaagcagaugacuuugagaaauauagaggaggcaaaacaaauaggacuugaugaaggaguggcuacacuguaaagaggaagaacuucagccauugaaaauaauuagacuuaugauuugcauaauuagauguaugcuaccuucacuaagagguaacacagugagccaaagauugauuaugaguugguuuuggacaaaguaaauuugaaggugaugagaugaugggagaugauguuaaacaugugucuaaagccuagagguuugaaucagagauauaaauuugcaaguuaccuacacauaaguauugacugcaacagaaacauggaggaaguuauuuagggagaaauuguagaaugaaaagaaaaaaagaacccaaaaguaagccuugagaaacuccaacuuuaaugacugagcagaggaucauauaaacuugaaaaggagugagaggaaagauuaucuagagagaugggagaaaaaccaagaaggcauuaugucacagauucaaaagaaaaccauaauucaauaaaaauguaauuauuaauaguaucaaaugcauaaaauaggaaucuuuuucuuuauccaaauauuaggucacaaucaauauggcuccacuauaaauucuuacuuuuccaauugccuguguuuauguauacuuacuuaaaguauucaucagaaggccacuguugucucgaaaucuauuaugacuggcaucuauaucaggaauccuguacugugucaugguaggauguccugagacacaauucccuguaucagaaguagaggauuugcaaucuucaucuucugagucacuagaacuauccucacuacuugaagaugaugaacuuuuggaaucugaugaacuaucacaacuacucaucugguccauuagacuagcuucugccuucaguucugaaaauaagacagaaaugaauagauagguuaaauaaaaaaugcuaaauaaauauaauaaaaauugaauguauuaguuuuuaagaaacuguugaaacuaaaaucaaacauacauuuacaguacuugaagcauuuuauuaaaaaacaaaacucuucuaccaucaagccauacuucaaugauuggauuacagaaacuaaaagggauagacaaggucuaaaucuaaacuccacauuuauuuaaaccauuguacuuaaguauacagguaacucaaauauaaaguaaauacugugaaaaacuauaaaaauuaaaaucuauuuuggcagaaacugucuucugauuauuuuuuguuccuuuaaauacauauaauauaaugugauaauguaacagaugaacuucauucuuuuccugguuuuccuagagaacauuuugaugaagcaucuauagguuuccccccugcucccuuaauaaggauuuaaaauauucuaaguauuuuugaagagccaguucccauuauaacuuuggcuauaaauauuucuguagauaaaaagaauaauaaugaugucuucuuuuguuuagcauuuuucaaguucuagauacacaaaaaaauuauaguugggaaggucuucagcuaccauuuagaacaacuucauaauuuuauaaaugagggaaugaagauccagaaaugucaaaagcugucaguuauuuaugaguggaggcaaaucuacugacuuuuaagucaauauuuucccauaugauacaaaugucaaauaguugaacaaaauuuuuuaaaccaaaaaaugcuaagugaauaauacacucaguuaacacauugacauuugauaucaucuuaguacacugcuacauuaaguuaacugguaauuuuuagcccacuuccucauucucccuauuauagacacacuggcuuucuauuauuugaccacauuaaauccauuuccaggcuauguucuucguacuagcuguuuccucugccugguauauucuucacccagaucuuuuguuuguuuguuuaauacauaauuuccauaaaguaaaauguacagcuagauaaauuuuagcauguauaaaaccuguauaucuaccacugagaucaauauauagaauauuuccauucccaugaauauucuccuaugcucuuuuccagucacuaaucaccauuuugacuuuuauuaccaaagauuuuugucuauucgucuauucuugaacuucauacaaauagauucacucagcauguacuuuuuggucugccuucuuucaacauaauguuuuuauauuuacucauguuauugaauuaaucuguagccuauucuucucuacugcuaugauauuauauuauauuauauuauauaaauauaccacaaguuaguuacccauuuucuacuuauggauauuuggguuguuuucaguuuuugauauuauuaauaaaguuguuaugaaaaucccuuuacaagucuuuuugaacuuauauacacauuucucuuagguagaaagagagaaauugccaagucacaauaggcauagguuuaauuucauuaaaaacucccaguuuucaaacugauuuuacacuccaaccagcaagguaugagucacagaugcuucauaucuucccucacuagggcacacacacacuugguauagugagucugaaggguguacaaugguaucuucuuguaguuuuaauuuucauuucuuugaugugauaauaugaagcaguguuuuuuuauaugcuuacuggccauuugaauaucuuuuuugaaaagccuguucaaaucuuuuguccauuuuuauauuuguuugucuuuuucuuacugauuuguaagaguucuuuauagcuaauucuucuggcuaugagcccuuugucacacuuuuggcauuugugaauauuuuuuccagguucccccaagucuguagcuaggcuuuucauuucauuaauggugucucuugagaagauucuagaucucugaaaggcuggcuccuucuugaaucgguuuaaguguaaccuucucaaaaguuuccuucuucuccauucuccaacccccauugcuuaguuuaauucucuucaagacacuuauuucugaaauucauuuggauacuuauuuguuuacugcuuguaucuucccuacccucccucucacccucauccauacuccuaaauaaaaugugagaauagcaauguugucuuguucauguugcauaauuauuguuauacaauguuggauucaauuugcuaauauuucauugauaauuuuugaguuuaaguucaucagagauauugguucauaguuuuccuuuucuuguacugucuuuaucugguuuggguauuagggguaauacuggccucauaaaugagcuuagaaauauuccuuccuuuuccuuuuuccagaagagauuguguaauguugguguuaauucucuuuaaauguuugguagacuucuuggucuggcuauuuuuggggugggugcuuuuuaauuacuaauuuaauuuauuuaauauugauagcacuauucaaguugcuuacuucgccuuaguugaguuuuggcaguuuuuagcuuuugaggaacuaguccauuuccucuaaacugucaaauuuaugagcacaaagcuaucauauuucuuuucucuucuuuuuagauagggucuuacucugucacccaggcuggagugcaguggcacaauuauggcucacugcagccucaaccucuugggcucaagcaauccacucaccucagccuccugaguagcugggacuacucaggugcacaccaccacgccugacugccugaguaaucuaaaaaaaaaauuuuuuuuuuuguagagacucuguauugccuaggcuggucucaaacucccgggcucaagcaacccucuugccuuggccuccgaaaguguugggauuacaggugugaaccaccacacccagccuaccauuucuuuauaauacuuuuaauggcuacuggaucuauaguaaauucauuacuuuccugauuauagauagaaguuguacuuuacauuccugauauucguaauuugugccuucugucuuuucauuuuuaucaaucuuacuagaaguuuaucaacaguguucuccgaugacugccuuuuuguuucauuaauuuucucuacuguuuucaauuucauugauaucacuucuuauuuucauuauuugucucuuuuugcuugcuuuggguuuaaucugcuuuucuuuuccuaguuuccuaaaaaagggacuuaaauuaauuaauaugauaacuuuccucacuucuaauguaagcauuuagugccauaaauuucccucuuagaacuucuucaguugcauuacacauauuuuggcaugcuauguuuacuuaauacauuuagcugcauguauuuuuaauuuccuuugaugauucuucuuuaacccauggaucuuuuagaaauguguuuaauuuucaaguguuuagagauaucuccuguugucuguuauugauuuuuaguuugaauccauuauggucagauacauagucugcaugacuucagucucuauaaaucuauugagauuuguuuuauggcccaggauauggucuaucuuaguaaauauuccaugggcacuugaaacaaaauguguauucugcuguuguguggcauguuacauaucugucaauuacaucguguggguugauuguguuacucagaucuccuauguaugugucgauuuucugucuaguaguucuauuaguugcugagagcagaguguugaaauacccaggcauaauuguggauuugcagauuucucuuuucaguucuagcaguuuuugcuucacguuuuucucaguucaguucaguuguuagauguauacacacuuaugucuuucugguaaaucaauacuuuaaucauuguuaauguaccucuuuguaguaauuuauuuauuuauuuauuuuugagauggagucucacucugucacccaagcugcagugcaguggcgugaucucagcucacugcaaccuccgccucccaaguucaagcgauucuccugccucagcuuccugaguggcugggauuaaggugcgugccaccgugcuuggcuaauuuuuguauuuuuaguagggaugggguuucaccacguuggccaggcuggucacgaacuccugaccucaagugaucugccugccucggccucccaaagugcugggauugcaggcgugagccacugcgccuggccuauuuugcucuuaagucaucuuuaucugauauuaauauggucacauguuugugcuuuuuaaaauuaauguuuaaaugguauauauuuucuauucuuuuacuuucaagcuacauauuucauuaauuucuuauaaacagcauauaguuggguguacuuuuuauacagccugccaauaucugcaguuuaauuggcuuauuuagacaauauauguuuaaaguaauuauugauauauguuagggcuuaagugugucaauuuguuauuuguuuucuguuugcuuccucuguauuucauuucucuguuuugcuugucuugccuuucuguggguuacuugaaacauuuuagaaugccaucucaauuaauuuauaaaguuuuaaaaggugucauuuuguuuauuuuucuuagugguugguuuggguuuuucaauauacauaccugacuugucaaugcauucccauucuaaguaaccucauauccacuuugaaauaucauuauuuugggaaucagaagguauuaucauuuuuguuucagucaucacauaugauuuagaaaagucaugaggaaaaucauaaucaauuguacuuauugauauguuugcucuuucuguugcuguuucucucuuccugauacucuaagauuccuucauuuaacguuucucuucugucugaaugacuuuauacagccaauauuuaaggauaguuuccuaggaacaaauucuuucaguuuuccuuucugaagcaggcuauuugccccucauuacugaagaaucauuuugguagauacagaauucacacuuaacauuuuuuuucuuucagcacuugaaauauauuaugccacuccuuucugggcuccauggcuucagaugagaaauaggauguuaaccaaaugguauucuuucauagguaauaugucauuucuuucuugcuuucaacccuuuucucuuugccuuuaguuuucagauguuucauuaugauguaccuuggcaucaauuucuuuggguuuauccuauuuggggcuuguucggguuuuuacaucuguggguuuaugucuuucauaaaacuugggaaguuuuugcacauauuuauuuaaauacucuuuuaacccugcucucccucuucuuugagacuccaaugacacaaauauuggauauuuuaucauucuuccacagauucuuggggacaugcucaucuuguuucagucuauuuucuauuuucagguugaggggauucuauacauccacaaguaaacugauucuauccaaucccuagcacugagcccauccagugaguauuuuuguuguuauuguauuugucaguucuauaauuuccaucugauucuuacuuaaaacuucuauuucuuuaaugugauuuucuauuuuguuuuucauuuguuucaagggaauguauaacugaacgauauucgugauaauuguuuaaagaucauugacagauaauucuaacauuugauucauccucguguuggugucaguugauugucuuuucucauucacgugauucucuugaaucacaaauuacgguacgacagguaauuuuauuuucuuuuucuuuuuauuuuuuauuuuuuuuauuuuuuuaagauggaguuuugcucuguugcccaggcuggagcgcaguggcacuaucuuggcucacugcaaccuccaccuccuggguucaagcaauucuccugccucagccucccaaguagcuggaauuauaggugcgugccaccacacccagcuaauuuuuguauuuuaguagagacaggguuucaccacauuggccaggcuggucucaaacuccugaccucaagugaucugcuugccuuggccucccaaagugcugggauuacagaugugagccaccgcacccagccaggacagguaauuuucuauuauaucuuggauaucuugguuuuuaugcuaggggagaucuauaucuuauucaaauuuuuaauuuuaguaggcaaucacucuguuuagguuuagcaugcauauucuugccuacuguugugggcuguaguuuaaaugacaaucucguuuucagaguuuuuacaguauugucuuggucuucucaacuaaaucuccagcagcuaggguccccgaugaucccugcuggugccacgugaaggaaagaagggacuucaccaggcaaggagauguggugcguauaggugaaagggagucucuugccugggauaaagagugcuuccugaaccaggcaauuuuuuguugugauuggcuccccugcuuggagagguggaggaaaggaaagugcuucauagcaaaguguuuguuguggcaggauccccuuuauuggugcgauccagucucaagaugucuuuagaugagagagaagaaucuuagguuaauagggcaggggggcaggucugggagguagagugguguaaacagucuucccaggcugaaugcuuauuacaguagaauucuacuugcagggaccuucuggccauagagugucucugauggaggaagggaaccucaggccaggcaugcaaggagaacacuuugaggaaugcagucacucacugugguaucauccuauuuguugguacucccagcugugaguugucuccggguaggggaguagaauuuuagauccaucuuauuucuuuuuuaaaaaaauauuuuuuuuuauagagauggggucuugcuaucuuaaacuccuggccucaaacgauccucccaccucggccucccaaagugcugggauuacagguguaagccacugcaccuagccucuaucuuaucucccaaacucaauucuagauagcucaaagauguaaauguaaaauuuaagcuacaaaaauauuaguacaacugccagacauaaaccugaaaaggugauucaaccauuuuaacaguagucaguggcacaguagggucaagaaaauauuuuauagaaugcaaucuaaggaauauguuauacaaauaucucaagguaaaugaaguuccauucucauacuaaguuagaaauagaaagcuuuaugguuggagauuguguuaaccucuacaacuuucuuuuuuuuaacuuuuaauuuuuacaauuuuuuaauugagaugagguuucaccauguugcucaggcuguucucaaacuccugggcucaaaugauccucccaccuugggcccccaaagugcuggaauuauaggcaugagccacugugccuugccuccucuacaacguucuuuucccugaguuaugcuuugauacaaugcuuuuauuaaggccucuauuaaaaaacuaccacauggaagaacuucuacuuguacuguaaaauuauuguugagaauacuauauaaaguuuaaugcucccuagaaaaagguuccauaugaugaauuccuuuuagaauuuaguaacaggaaaaagucugauucuuuguaaccuaucagaugauacaacauaugcugcuugugucucccuuaugucuuggugauuagaagcucagagcuaaauuauuauuacuauuauuauuauuuuuugagacagagucucacucugucacccaggcuggaaugcaguggcacaaucaugacucacugcaggcuugaccuccccaugcucaaguaauccucccagcuuagccucccaaguagcugggacuacaggcauacaccaccacacccagcuaauuuugcauuuuuuuguagagaugggguuuuaccauguugcccaggcugcucucaaacuccugagcucaagugauccaucugccuuguccucccaaaguacugggauuauaggugugcaccaccauacccagcaauuuaauguguuaaugauuagcaaauuugccuucccuuccccuucaauaucuugauuuucuguaccaauauuuuauuguauucauguauauaaagacaucauaauucaaauccauuuggaagcaggcaugauguaaaaaaaaauaaaauucaagacccguuguaucgccaaggguucuggacuugucuuuuuuauuguuuguauaggagcuacuaaucgauuagagaaugaauacucuacugggcuuagaagggaacacugaaauuggacagcuaugugaaaauuuuaagaaggcaaaguguagaagcaaauaugcuuuagugaccagggucucacugcagccacaauuacuacaacauugauaacccacacugcagcuagaaaaaaaauggagauuuaaguuuucuuacuuacaaaaggacuguauguacuuccccaaaaauaccucccuucugagaaguaagcagcaauucagaaaaaguugccugcuuauucugcuuacuauauuuccucauuucccuauggaauuggugacaucuuaaauaucuacagucuggccauacauaaaaaauuuugacaggaagaugcugugaggaauugaauuugagucaucacaauugccaaaaagaagaaaacuccaguuacauauaucuaaagagucauuuuuuuuacccugaauaguaauuuaaaaugauacaaggggagguuccaagauggcugaauaggaacagcuccagucuacagcucccaccaugagccacgcagaagaugggugauuucugcauuuccaacugagguacuggguucgucucacuggggcuuguuagacagugggugcagcccacagagugugagcugaagcagggcagggcauugccucacccgggaagugcgaggggucggggaauucccuuuccuagcaaagggcagcugugacagacaguaccuggaaaaucgugacacucccaccccuaauacugugcuuuuccaauggucuuagcaaacggcacaccaggugauuauaucccgcaccuggcucggagggucccaugcccacggagccucauucacugcuagcacagcagucugagaucaaacugcaaggcagcagugaggcugagguaggggcguccaccauugcugagacuugaguagguaaacaaaacaaagcagccuggaagcuugaaccagguggagcccaccgcagcucaaggaggccugccugcaucuguagacuccaccucugggggcagggcauagcugaacaaaaggcagcagaaacuucugcagacuucaacgucccugcugacagcuuugaagacagcagugguucucccagcacagacuuugagaucugagaacggacagacuuccuccucaagugggucccugacccccgaauagccuaacugggagacaccucccaguaggggcugacugacaccucauacagccaagugccccucugagacgaagcuuccagaggaaggaccaggcagcaacauuugcccuucugcaauauuugcuacucugcagccuccgcuggugauacccaggaaaacagggucuggagugcaccuccagcaaacuccaacagacugcagcugaggguccugacuguuagaaggaaaacuaacaaacagaaaggacauccacaccaaaaccccaucuguacgucaccauuaucaaagaccaaagguagauaaaaccuuuaucuaccuuuugggauaaaagauggggagaaaccagagcagaaaagcugaaaauuccaaaaaucagagugccucuucuccuccaaaggaaugcagcuccucgccagcaauggaauaaagcuggacagagaacgacuuugacgaauagagagaagaaggcuucagacaauuggugauaacaaacuucuccaagcuaaaggaggauguucgaacccaucgcaaagaagcuaaaaaccuugaaaaaagauuaaacaaauggcuaacuagaauaaacagcauagagaagaccuuaaaugaccugauggagcugaaaaccguggcacgagaacuacgugaugcuuccacaagcuucaguagccaauuagaucaaguggaagaaaggguuucagugauugaagaucaaaugaaugaaaugaagugagaagagaaguuuagaguaaaaagaguaaaaagaaaugaacaaagccuccaggaauacgggacaaugugaaaagaccaaaucuacguuugauugguguaucugaaagugacagagagaauggaaacaaguuggaaaacacucuucaggauauuauccaggagaacuuccccaaccuagcaaggcaggccaacauucaaauucaggaaauacagagaauaccacaaagauacuccuggagaagagcaacuccaagacacauaauugucagauucaccaauguugaaaugaaggaaaaaauguuaaaggaagccagagagaaaggucggguuacccacaaagcgaagcccaucagacuaacagcagaucucucggcagaaacucuacaagccagaagagcaugggggccaauauucaacauucuuaaagaaaauaauuugcaacacagaauuucauauccagccacacuaagcuucauaagugaaggagaaauaaaauccuuuacagacaagcaaaugcugagagauuuugucaccaccaggccugccuuacaagagcuccugaaggaagcacuaaacauggaaaggaacagccgguaccagccacuacaaaaacaugccaaauuguaaagaccauugaugcuaggaagaaacuacauaaacuaacgagcaaaauaaccagcuaacaucauaaugacaggaucaaauuaacacauaacaauauuaaccuuaaauguaaauaagcuaaaugcuccaauuaaaagacacagacuggcaaauuggauaaagagucaagacccaucagugcacuguauucaggagacacaucucacaugcagagacacacauaggcucaaaauaaagggauggaggaagaucuaccacgcaaauggaaaacaaaaaaaaagcagggguugcaauccuagucccugacaaaacagacuuuaaaccaacaaagaucaaaagagacaaggaaggccauuacauaauggaaagggaucaauucagcaagaagaccuaacuauccuaaauauauaugcacccaguacaggaguacccagauucauaaagcaaguccuuagagacauacaaagagacuuagacucccaaacaauaauaaugggagacuuuaacaccccacugucaauauuagacagaucaaugagacagaagguuaacaaggauauacaggacaugaacucagcucugcaccaaguggaccuaauaaacaucuacagaacucuccaccccaaaucaacagaauauacauccuucucagaaccacaucacacuuauuccaaaauugaccacauaguuagaaguaaagcacuccucagcaaauauaaaagaauagaaaucacaacaaacugucucucagaacacagugcaaucaaauuagaacucaggacuaagaaacucacucaaaacgcacaacuacauggaaacugaacaaccugcuccugaaugacuacuggguaaauaacaaaaugaaggcagaaauaaagauguccuuugaaaccaaugagaacaaagacacaacauaccagaaucucugggacacauuuaaagcaguguguagagggaaauuuacagcacuaaaugcccacaagagaaagcaggaaagaucuaaaaucgacaccguaacaucaccagucaaagaacuaaagaagcaagagcaaacaaauucaaaagcuagcagaaggcaagaaauaacuaagaucagaggagaacugaaggagauagagacacaaaaaacccuucaaaaaaaucaaugaaucuaggagcugguuuuuugaaaagaucaacaaaauugauagaccacuagcaagacuaauaaagaaaaaaagagagaagaaucaaauagauacaauaacaaaugauaaacgggauagcaccacugaucccacagaaauacaaacuaccaucagagaauacuauaaacaccucuaugcaaauaaacuagaaaaucgagaagaaauggauaaauuccuggacacauacacccucccaagaauaaacaaggaagaaauugaaucccugaauagaccaauacaggcucugaaauugaggcaauaauuaauagccuaccaaucaaaaaaaggccaggaccagacggauucacagcugaauucuaccagagguagaaagaggggcugguaucauuccuucugaaacuauuccaaucgauagaaaaagagggaauccugccuaacucauuugaugaggccagcaucauccugauaugaaagccuggcagagacaacaaagaaagagaauuuuagaccaguaucccuggugaacaccgaugugaaaauccucaauaaaauacuggcaaauugaauccagcagcacaucaaaaagcuuauccaccaugaucaagucggcuucauccuugggauacaaggcugguucaacauaugccaaucaauaaacauaauccaucacauaaacagaacgaaugacaaaaaccacacaauuaucucaauagaugcagaaaaggccuucgacaaaaaucaacagcccuucaugcuaaaaacucucaauaaacuagguauugauggaacguaucucaaaauaauaagagcuauuuaugacaaacccacagccaauaucauacugaaugggcaaaaacuggaagcauucccuuugaaaacuggcacaagacagggaugcccucuuucaccacuccuauucaacauaguguuggggagcucuggccagggcaaucaggcaggagaaagaaacaaaggguauucaauugggaaaagaggaagucaaauugucccuguuugcagaugacaugauuguauauuuagaaaaccccauugucucagccccaaaucuccuuaagcugauaagcaacuucagcaaagucucaggauacaaaaucaaugugcaaaaaucacaagcauuccuauacaccaauaacaaacaaacagagagccaaaucaugagugaacucccauucacaauugcuucaaagagaauaaaauaccuaggaauccaacuuacaagggaugugaaggaccucuucaagcagaaauacaaaccacugcucaaaaaaauaaaagaggacacaaacaaauggaagaacauuccaugcucauggauaggaagagucaauaucgugaaaauggccauacuguccaagguaauuuauagauucaaugccaucuccaucaagcuaucaauggcuuucuucagagaauuggaaaaaaacuacuuuaaagucauacagacacaaaaaacagcccgcauugccaagacaauccuaagccaaaagaacaaagccggaggcaucacgcuaccugacuugaaacuauacugcaaggcuacaguaaucaaaacaccauaguacugguaccaaaacacauauauagaccaauggaacauaacagaggcuucagaaaucacaccacacaucuacaaucaucugaucuuugacaaaccugacaaaaacaagcaacggggaaaggauucccuguuuaauauauggugcugggaaaacuggcuagccguauguagaaagcugaaacuggauacuuuccuuacaccuuauauaaaaauuaauucaagauggauuaaagacuuaaauguuagaccuaaaaccauaaaaacgcuagaagaaaaccuaggcaauaccauucaggacauaggcaugggcaaggacuucaugacuaaaacaucaaaagcaauggcaacagaagccaaaauagacaaaugggauaugauugaacuaaagagcuucugcacagcaaaagaaacuaccaucagagugaacaggcaaccuacagaaugggagaaaauuuuugcaauuuacccauuuuacaaagggcuaauauccagaaucuaugaagaacuuacacaaauuuacaagaaaaaaacaaacgacuccaucaaaaagugggcaaaggauaugaacagacacuucucaaaagaagacauuuaugcagccaacagacacaugaaaaaaugcucaucaucacuggucaucagagaaaugcaaaucaaaaccacaaugagauaccaucucacaccaguuagaauggcgaucauuaaaaaggcaggaaacaacaggugcuagagagauguggagaaauaggaacacuuuuacacuguugaugggacuguaaauuaguucaaccauugcggaagacuguguggcgauuccucaaggaucuagaacuagaaauaccauuugacccagccaucccauuacuggguauauacccgaaggauuauaaaucaugcugcuauaaagacacaugcacacguauguuuauuguggcacuauucacaauagcaaagacuuggaaccaacccaaauguccaacaaugauagacuggauuaagaaaauguggcacauauacaccauggaauacuaugcagccauaaaaaaggauguguucacguccuuuguagggacauggaugaagcuggaaaccaucauucugagcaaacuacugcaaggacagaaaaccaaacaccacauguucucacucauaggugggaauugaacaaugagaacacuuggacacaggguguccaucacacaccggggccugucaugggguugggggagaggggagggauagcauucggagauauaccuaauguaaaugaugaguuaaugggugcagcacaccaacaugccacauguauacauauguaacaaaccugcacguuguguacauguacccuagaacuuaaaguauaauaaaauaaauaaaaugauacaaauucucuuauauggauauugcuuacauaaaacuaaaaaucauaagcuacaucauuacccagaaaaaugcguaauuacaaaaaauauuaugcucuugguaaacauuuauaauuaguaccacuguuaauuaaaaugaaaaaauucauuuagcauuuuuuuuucuuuuuuuuuuuuuugagauggagucucaccgucacccaggcuggagugcaguggcgcaaucucagcucacugcaaccucugccuccuggguucaagugauucuucuaccucagccucccgaguaggugggaccacaggcacaugccaucaugcccagcuaauuuuuguauuuuuagcagagaugcgguuucaccauguuggccaggcugguguugaacuacugaccucaugauccgccugccucggccuccuaaagugcugggauuacaggugugagccaccaugccuggccuuaacauuucuuaauuaucucuuauaaagggauguuacauauacuuagauuuuaccucuuucgauaucaucuauuggagaugcuggggacaucuuaucuucagauggagaauguuuuacaagauugggaguccuggcugaauuccacauuuguuguugcuguuguucuuuacgauacugaauuuuacugcuuccuucaacucugcaauuaagaauaucaaauauugaaacagguaugacagcaauguaacaaaaauuuaacuuacaaaguuacuaaaacugaccacuuauucuuuuccuaaacaucuuuagaauaauauuccauaauuaaaacauuaauuuaguucauuauuuaacaaguauuuaucaaguucuauuucugugauacacauguccauugagggauacaaacaagaacaaaaacaaaaccagugccaggcuuggcgccucaugccuguaaucccagcauauugggaggcugaagugggaggauuacuugaggccaggaauucaagaccagccuugucaacauaacgagacccugucuguauaaaaauaauaaaaauauuagcugggcaugaugaugcacaccuguaaucucagcuauuuaggaggcugugggaggaucauuugagcccaggaguuagaagcugcaguaagcuaugauugcgccacugcacuccagccugggugacagagugagacccugucucauaaaacaaaaacaaaaauccaggcuggugcaguggcucaugccuauaaucccagcacuuucggaggcugaggaaggaagaugguuugaggccaggaguucaagaccagccugggcaauauaacgagacccuccaucucuauuuaaaaauaaauaaaacaacaaccaaaaaaaaaaaaaagccauugcuuaaauugaacagauaagauauucacaaaugacuaaaauaaaaggaaaaauauaaguguauaacagguacgauauauuccguaaguucuaagauuaucauuucuguuaaaacuaaaucacuucuaaaguuuccauucauaacuuaagacaggcaugauaauaaaggagauucauauacuuuucuuucaauaucuuuaagaagaguguaguauaauaaaaguaugcuugauuuuugccucucccauuuccagucaccaaauccugucaguucuuccuucaaaaagucuuuagaaccucacuuucucuucauuccugcccucaaaaauccugguuuauacauuuuucugauuccuacauuguuucauuuacucaguuucucuacugaauuaauguuuuaaaacaaaacuguaaacaugccaaucccugguuaaaaagacuuuaauauguaacgacuaccagcaagauaauguccuaauuucuuaguuaauauugauggcacuaaccucaaccaacaaaauuacaaccuuaccucuagcccaauaucaacaucgcccccuacuuuccaaaacguauacacagguacagagacaaaccucugcuccguucaaguaggucuuacucauuggcccugaauaaaucagauaucaaacuugucuuacauucucaucuccucucuaaucaauuaaaucgguauugcacaaacuuucuucuggugugaaucacagcagggcauggaugguaggggugaggggauauuaaaaaauagaguuucccaggauccuucccugauuuaagguuggauucgggaacuaauuuuuaacaagcacccaagguaauucuuaugauccuaaccuccucuuaagguacaucaaaaaggccucccugaauuuuccaaucuaccauuacuucuccuuuuucuuaauuccuagagcaauuuuugucuauacuauuugcauggcuuuuagagcaaacauccuuauauuacaggguaaguaauguguuaccuauuuccaaaaaggauuugagauggguauauucuccuauugacuuuuuaaauggaauagucuguuuaucugaauaaaaugcagaaguuuugagguguuugcagagcaaacuuuccuuuuucuaguaccuuacacauccuagguacucaauaaauuuuuacuaaugaagaugaaauuauuuuagagaauguauaauggcuuccuucaauccaguuauacagaaguaucuacaauaggauaaaaaguguaccuauaccuauagaaagcauuuagaagcaaaacaagcuuuuauauaucacaggguaaugugguaaaacgcuuuuugcuuaggaucuccaccaaauuuaaacuuagaaaaagauuaaaacauuuuuguaccacacagaaauaacuccuauauuauaaugugacuuaauaaauuuuuuauugacauuuccuuagaaauuuauguuuauaauauaauuuauuucauuaaaccacauaccuuguuuuuuuuacagugauguugcugcugaguuuuucuagccgacauucuccaguaucaugguuaauaaucaaaaugcauucuuuuaaguaagguuuuuuugaaccuuugaaaacaguuacugguggaguugaacccuguuuaaaaaguuaauuauuauuacuuaaaauuuaucauaggaauucacuugggaaggccuuugaaaucuugauucuggguuucuccuucuauguuauacuucaagucacccauaaacuaccuaaauuuacuacccugaauccaaagaguguaguaaaaaagacagaugaagauaggcugaaaucucaaagcugcugucauugaggaaagggaagacaggagguacucaccuugggacaguaaagauuuguuucuuuggccuauaaugaguaauugagauucaauucgaacacaaccaauauauuuuauggauaaggaaacagagccuugaaucauauuuucuauuccuccuuuuuuuuuuuuuuuuuuugagacagagucuugcucuguugcccgggcuggagugcaguggcacgaucucggcucacugcaaccuccaccuccuggauucaagugauucuccugccucagccuccagagcaguugggacuauaggcauggacaaccacgcccagcuaauuuuuauauuuuuaguagagacgggguuucaccauguuggucaggcuggucucgaacuccugaccucaagugauccacccaucucagucucccaaagugcugugauuacaggcagaagccacugugcccagccuccucaucuucuuucuuauugcuuuauaaguuuaauuuuuaaaaucuggcauuuucuuaaagcaguaccucccuaugcauauuaaggaacaccucuuacacuaaacccacuaauuaaauuuagcauaauuaaaaguaagauaagcagacauuaugugcuuaaugaugucauaugaaaguacacugcgccauccauaaaauacucuugccaaaaaccacacaaaaaccccaaagaauuuaauucuuaucaaaccccaaagaaucuguaauccagccugcccuuagauauauaacuaccaauauauagaaaauagaaggaauagaggaacaaguuaaauacauccagauagaaguaauuugaaguccagaauguagguauauucucuaggacagauaguacgguuuuuccaacaaaccaauggcauaaaaaagagaagagagccaggugcaggcacuguaguaccagcuacuuguggaggaugggugcugaagcaggaggacagcuugaagccaggaguucuaggcuucagugugacauaaucacacccgugaauagccacugcacuccaaccugggcaacacagugagacccugucucuaaaaaagauaaauuaaaaaagggguggagaagaaaggaagggacuuuuaaagaauaaaagagacaagaaauacaauauucaaauacaauguagaaaucuuauuuggauucuaguuaggacauuuuacagacaaaugucuguaaaaaacacguuuuugagaucaucacaaaauugugacuauggacgaaguauuaucaauuauguuauuugugauaauagcauggugcuuagauagaaauguccuuaucaguuagagauacauaaguaagcauugaugaaauggcacauugucugggauuugcuauaaaauaugccaaggaaaaaaaugguaagacauuagauuaaaaaauaaaaagauuagcaaaauguugauaauuguuaaagcucagugauggguacauguaauucauuauacaauucuguuggcaauaaaagaaaccuagaucauuacuaauaaacuacaucuacuuacaugcuccuccccuaucuuuugucccugcuccaucaaaccugaaggaauuuuacguuugucauucuuuugcuuuaucccacauauauguauuucuaaacaauuauuuguguauguuugucuuuggaguuuauaaaaguacauuaaauuuuaauggauuuaucauaauaauuuuaucaaauauuacaaaaauaauaaaauaguacuguuagaucagguuagaaaaggaugaccucuaaaaaggcuaagugguguaucauauuaaaguuaaucauuagagauuuacuaaaugagcacuaggaggaguauaagauaaauuagguaauugaaaaugccauaaaagauggguagguuagagauuucugaagguauggagggaaaauuauaaauguaaaauaaaggaacaguuguuuguggguuuuuuaccucucccaaagacuaaaguaaucuacagaaaaucaagaaugcacaacacguagaugaagacaugucugggcuagcucuaaaacgguuagauguggagcacuuaguugaagcccugguaagcuggagagucaggagcaugauuauaaccaaacaaagugggucuacuuggcugguaaguaaauuuuucagauguguugacugaaacaaguaagauaccccaaaauaguuaccuaaggacuccaaauuacaguugauaagagauuugugcaagauauucuuaaugauaucuguacucuuaauuagaauggaauacaucuaaaaauuacaauguauuauuguucucugagcuccugaaaauaagaacuaaucauuaauuuuuaaaaaauugcucucagcaccugaagaaguaucaagaccuuuauaaauauucaaugaagguuaaauaugaauaauauagacaauuucuggucauaaguaacaaaugaaacaaaucuuucauaaucucuacaccugccaucuacauuuugaacaaguuuuauaaauguaaacuuucucccucauuaaauugaacaccauuccuaacuuuuaagcuucaguuucuguccauuccuuauucaauaccccaagaaaggcaacuacuaaaguaccagacaacuacuaagcauaugaacuaucauugccucuaaauaacuauugaauaccaccuaucggcuccauguucacugugaugacacaccuucaaucgucauucaccuagauuauuguuauucuccucccuacucucuuuccaauuuuguuccccauucugugagcaggcaaaucuaaucguauuguucccuugcuuaaaaaucuuucugugcuuaaaaaacuguguauucagauaaagccauauuccauaaaccugcacauggacccuccaugaucuucucaucuacucuccaacuuucuuaauuugccacuguuuacaaaccacauagaauugcuuauaauugguucacaugaaugacugacuuaggauugucaaccaaaagacaaaacuguaaaauaaaauauaaaauaagugagugggucauguguggugacucaugcauguaaucccaccauuuuagauggcuaaggaucacuugagcccaggaguuuccgaccagcaugggcaacauggggacaaccuguguccacaaaaaaaaaacuaaaaauuagcugggcaugguggugcacauuuguaguccuagcugcuuggaaggcugaggcaggaggauugcuugagcccaggaguuggaggcugcagugggcuauaauugugccacugcacuccagccugaguggcagaaugaaaucuugucucuaaaaaauaaauaaaauaagugcgugcauauguuauuugagggaauaaaaggacucuuaaccauacaacaaaggaaucagaaccaacaccucaacauaggggaaugaagagaaaauauaaauauaaauaaaagaagugauaaaagaaaucuggcuauuuauauauacuuaacuuuaaauggauaagaauagacuuggccgggcacgguggcucacgcuugcaaucccagcacuuugggaggccaagggagguggaucaucugaggucgggaguuugagaccagccuggucaacauagugaacccccaacucuacuaaaaaugcaaaaaauuagcugggcaugguggcgggcacugccuguaaucccagcuacuugggaagcugaggcaggagaauugcucgaacccaggagaugcagguugcagugagccaagauugcgccacugcacuccagccugggugacagagugagacuccgucucaaaaaauaauaaaaaaaagaauaagaauagacugucugagaauguauaauguaagagcuaaauaaguauucuugacaugaagauauucuauaauguaacacaauaucuuggcaaaaacuuaggugcuuggcugagguggaaagaaagagaaguggaagggaggagaaaaaaagucuuauuauuaagggauaauaaauguauucuaaaaaucucacuugauagagguaggaaaauaauggaggaacucaguuuucauauaagaaaauaaaaucauaugccucauuaugaacaccaggaaaagaaaauaaucaauaauggaauggaaaaguauacuaguacucccaaaguaauaagaguaaucaaaaaaagcaaugaaaaaaaaaucaaagacaaagggaaaaaaagaaaugguugguaaaacuaauaaagaauauaaaagaagaaacaacaaauauuuaaaaacuaauaaacuauaagauaaaaaucaaguauaucaauuuugaacuaaaugugaauagacugaauagacaguauucucccaauaaaaauagaaagugccaaacuggguuuaaaaauaaaacagcauacuauauuaacaaaagauauacuucauacaaaaugucagcuaaauaaaaggaagaaacacuaagauucuaugaauacacaaaagaaaaaaaguaaagauagcuauauaaauaucagcuaaauaaaaggaagagacacuaagauucugugaacacacaaaagaaaaaaagguugauauauauauauauacauacauauauauauauaucagagaaguaggcacuuaagcuuaaaaacacaaaaauaggacaaaaauguuauuuuguaauaauuaaagauauacuucauuaaaaaauauaacuuuaaaacaauguuaaaauaggacucugguccuaaaaucagaugaggucccaagaauguaauggacuauguuccugugucggcuaaguaaacccauuggagaaaaccagacuagguucauuugggaagggacuuugcccaagagggucaucuggaguaccccucauacauauaggagccucauaaguguaggauuugaggguugaauuauacauaaccacuagaaaugcauugccugaauaauagaaggauaguuagaaguuugcagugggcuauuucauaaaagcccacagaagcaccccauaagauaaagagucaaugccaaaaauaugccaaucucagcaccaaugacaagucuuaacagucaaguuaaguaaaacuuuuucuuucaaaauucgacacuuugaaauuuuguagcaaucauggagaacuguuuguaaggaagagagauucguaaaugcccacuauuuaaccagacuaucaguguucguuuuuauuaauuuuuuucuauuugguaauaccauagaaaccuaagacaaauggaauuagaaaaucuacccuaucaaagaaccaaacguacucuuaaaauuauaauauaauaaaagcucuauuuuauggucugacucuaagcuuccuaggcaguuauaccaggaugacgaaagcaaguucauauaaacaauagaagaaucuaaaugccucaaacuaauaaccauuacauuuccacaaaaaaccuacagaauuaagaacacugaagaaaagcaaaccuccuaccugcuuaaagauguucuuuaagugaagggggaaaccccucacaaagucuaucugagaauguaauuuccauuguuauucaugauuguucaaggacuacauacccaggagaaacaauauuugcuuuugacagauggugaucuaaauaacucuuucauucucuuuuuuuugugugggggggggcuuuuaaaauaacccuuauuuuuuaaaaguuaauaugugcacuauaggaaacugaaaagcacaagaagcaaagaacaaagucauuuacaaucacaagcaguuuauaguuugacauguucuucuagauccuguguguguguagacacaacauccaauuuuaugggacugccauuguacaguauguaucacgauuuuucacacaucaugaauauuuaccaauucaaaaucccaaagcuauaugaguauuuugauaaccaagaauacacuacaccaacucaaacugcuaaaaaaaaagugauccugccuuucuugggacaaaaauuucauagaagacaaaaauggcaacacgccucuagauaaaagcauuggcagaguugcgauuuaaaugcugcauucccuuaaugcucaauuuaaaaugaaacacacagcagcagaauacacuaaguauaauguuuuuaagagaauucauuagcagaucuauaccauuaaaauauuagcaaaguauauuuccauugaauuacuuaauguacuccuauagugcagccaaaagagaugcauacaucaauggcuaucaaaauguaaauauggacauauauggacacaucugcauacaucucugccuguauacuuccuucugccccucugcugccaaccuaaugaacaaguccugacauacacugcucagaggcggcuuaacaauuccauguccaaaaugcaucuuuucuaucaauuauaacaaagguauuuacaaauuggcuaauucacuagcucuaguuuuuaucauaaguugucacccuauucauaaagcuuagauguugcaaaauaaugaacuuuguccacaaugaacacaggcacuuuaguaaaaacgcucauauagaccugugguuaucaucuaaaaccauugucuagauauggagauacuagcaaagagcccuucccuucauccuuccucuucucccucuucuaccaucccagugacuaaguauaggaugucuagcuccaagagauggacuaauaaaggucacccccagaagacaggccuuccuaaaaacuaauaaaaggacauucauaaagggacugauuuacuacaucuauuuuuaacauacuuugagcauuaagacuuauccuuuaauacacaauauuaacuaaaaugcacauauaaaacaaugguuagaccaucugaacuaaucucaggagcacagaacccuucuccuugcauacuuccucccccccucuccccaacucuuucauuuucacuguuuaaaugaguuauaauuaauuuauauuauauaauagacccuuuaucaaucugauuccuaaauaucuaaauauuacccuccuuguccucauaugcacgccuuuugaccuagccuauauauaugccuacauauguaacuacauauaugccacuaggcauuauauguaguucuucaaauguuuaacaaacuuucuuuuguuguuguaucuuaguccuugucuuuuucuuuucucugacuaaaauguccuucccucucuccuuuaucuggguaacuuuaacucaucuucaaaacucaguguguccugaugucuccucccuguacccuggcugagauaccucucuuuccuguuucuuuaauauucuauguauaucuuuuuauaguucuuagauuucuacauuuuaaucaguuauuuccugucucucccauuaaaugauaaaauguuucaggacacugacugugucuagucuacuucuguauucccaguggcagcuaccuagaauaggacuuaucacacagaauguccaugcauauacacacacacaaauacugaggcauauucuuuuuuggacauaucugugggggcuuguggaaaggagcggugguggugguagugacuuuuucccaaaugauuucuuuacaauuucugaaauuuacaauucacaggcuugaaaacauaggccuccuguaacugugcuuccuuuaagacauauuucaauugagaccauaaccaaacaccuggaagaugguaacucuugguuaaagcaagauaugaaugaaugacaaggguuuauuauuaaacauaagaaaccucauuucuuuggaggagaagagcaaugcaagggaugaggaugggaggauggcaacuugagaaaacaauauucuacuuggcaaaaaaaaaaauccaacuaaagugauucugcaaaccaaucauuacugaucaauaauacuguauagccugagacaauagacuagugguuccuguuuguuguuguuguuguuuguuuguuuuuugagacagaguuucgcucuuguugcccaggcuggaguggaauggcgcaaugguuccugcuguuaaugugaggcuuuaaccucuuaaaauucagugguugguucagguuuuucuuuaauaaacaucauaaagcaaagaagccuuagguuacuggagauuaaauuuccaaauuguuuuagagauacuagaaccugaacaauuuuucauaacagaguaauacaaagauuaacuuaucuacaacaucucauacuaaauagauuuuucauuuccuucaguuccagagagaacaaauagaaauauucaauaaaaagcccauacaaauuuaauuagccuuaggaaaaucuccagagacgguaacugacacagucugacauaauagugggcucucaauaaaugguuaacugauaaaaaauaagaaaaagacagcagaugagaggauagagaguuuacuugcuauauguauaaccacgguaaaccaucucauuaaugcauaaaggagaauguggacggacuagcacaaaaccaccccauuacaaaaauuaaacaaaacaaagaaaaaaucucaaaaaauccagcauuuucuuuauguauuaaaguauaaaguuacagucuugauuuuuuucugagaauagacaaagucaguauaaaagaaaagaaaaagaaacuuaagcugaauacucaaaaauuucuaacucaaggacugagaaaacuagagcauacaacaaagaacuuauauuuguaugcgaauaguauuugguaccguuacuuggauacaucuggaaauuuuuuuaauggacaaaacuuuugguuagggccuccccugacagucucuuucuuuuuaaaaccacuccucaaacuccagcugaaguucuuucaaaaacacaaucuaaucauuagaauucuaaucauuggacuuucagccagaguuugaggagugguuuuaaaaagaaagagauuuucuaaucuaagaaaucuaaaucuaaucauguuaccucucuguauuaaaacuucuaaugguuuuuuaauaccuaugggauaaaguccaaauucuacauuacaacauaaaauauccuucacaauuucaucuugaccuacuuuucuagucucuguugcuaucaaucauuuuucuuuuucuuuuucuuucuuucuuuuuuuuuuuuuuuuuuuuuugagauguaggagucucgcucuaucgcccaggcuggagugcaguggcgugaucucggcucacugcaaccucugccucucagguuccagcgauucuccugccugaaccucccaaauagcugggacuacaggugcccacuaccacgacuggcuaauuuuuguauuuuuaguagagucagggcuucaccauguuggccaagcuggccuggaacucuugaccucgugauccaccugcuucggccucccaaagcgcugggauuacaggggugagccaccgcgcccaucccauuuuucauuauacuaugauuuacuacguaaagucacuuauuccacaaacucuuuguucuuucggcaucagagcuuuucacauacuguucuguuugcuuauucuacuccuugucuacccaauaaaaucuuacuuguccuuuaaaggcucagcugaaauauugcuugcuuuaugaagcuuuuuaagauuccaccaggcagaguauuugcuucuacuuaugugguuacauagaauuucauauaugcucuaacuuauaacacuagauguuaugugucugucugcuauaaaagauuaggacuagaaggcaagggauauguuacuauccuaaggucaguguuuaaaaucuggcuuauaguaggaauuuaauaaauauuuguuuagacucuaauuuuuuuucaaaucauuugcuaugauaguucuuggaacuauuaaauggacuaaaguauuuuaaguuuuuuuugccuaaaguaguuuaaaauaugguuuuugcuuaucugugcuuacuaauuacuuuaaccaauuaucacuacacaaauugugcaauuauuuucauuuaaauuuacugagaaucccacaaaagugaucacuuuaaagauacagaaauacucacuucuauauuuggcagaguuauggucaccuguucaccuucaccaaccucaagguauccuucagaagaagugucaauagaagcagguuugaagucaucuaaaaauagauacaaauaccaauuuuuguaaaauguaaugauauuuggauauaaaaauuaugagcauguuucagaaugauaaaucauuuuucaagagcuuuguaauuaaaaugguuuaaaguauucauauuacaaaugaacaaacaaaauacaaucuaguuuauuuauuucuguaugcauaauucugagaaaaaagaaauagcuauacucuaaaacagaauuacugacacucaugcuuccauagaauccuguuuagacaagaugaaccugacuaacauguucuacugcuaaaaacuaaauaaugucaguguuuucacaacuugcuaaaaaacugauauagguagaauguuuucaauuuucaguccuuuuuuccaauaaauuuuucuuuuuuaugucauuuuuaauggcugcugacuuaguucaugaauguuggcccauaaauuuuuuuuaaagcaccuuuggugccuacuaccacuugucugucauucuacuaccacuugucugucauucuauccaaacaaaaugaaugaauacauagcaaauacaguacauauuaaugaagaaacuuaagaaaaaguaaucuuucuaguuuaacaguuuuuuucaugaauauguacaccacuaaaugauguauaauuuaaccaaaucugucacuuuagaagaucuuaaaauacaauuuaauuuugaguuaaaucauaguucaaacgaugccauuaaaaucuaucaucuaggaggaaauucaggguacuaagauauuucacauguuaaacaagcuuaaaacccucuaagcaauuaaagccauuuaaaacuaauucauacgaauauacaucaacagcuaauaauucugauauauaguucccuguguuauauauacauuagcuccuuauuaaaauaugguauaaugcaaaagagaacaaaaauuaagcuuugacuuuuacacagugacacauguaaccaccaaccaaaucaagaaauagaacauuaccagcuccacggagcccccucccaguuauuacccauuguuccaaaagauuaaucuucauauuaacaaaaaggccccaaagacagaaagucuaaauccaaaguaauggauauuuauaaguggaauuuagggaauuauaauuagaaaaccuugggaaaggagaauuuuccaauaaucaucaaauuauugcucuguaaauaaacaaaggcuggcccugcuucacgaugacaauuaaaauagcugacauuuauggaacacuuacuacaugccaggcaccaugcuuaacacuucauauuuaccucuuauaacaacucugaaauaaaugaaauccauuccucuauuccuuaaauaaacauaaaugcaaaugaauauaaacaauuuacagaaaguauuuuuauaauauauucuucaugcugcuuuaauuaaaaauugaauaagaucuugaugcuuauuccuagauuuuaagauacaguuauaaaaauaacauaagcaauaugaaaaugugaaagaguuuugauuuacaguauaucccuagaaaguauaacugaagagucaaaggauaaagauuagacugaaaauaaguugaggaguuuguuagcaguggcaaagugagaaaagugaaagguauaauuaagguguuaaguuuuagaugcuugaaaaaggguuuggacugagggaaauaaguuuuaaauaaugucaauuguugaaaggacagugcuauugaggagaaaaaaaucagaacugaacuugaguaaguaucacagagauaaaguagaagaagccagaaaaucuaagagaaugaacacagauaugaacaaaaacaacaauaacagcuauuacaugcugaucaauuuuaaaaguuuuuccugaugauuuuuacuuugaagcuucacaccaauccugaaaaguagugaauaccccaucuuacagauaagggaagugaggguggaaaaaaauuaaguuccuugcccaagaucaugcaacuguuuucuaaagcuagaaaaacgaacugcaaaacccaguuagaauaaaaaagaugaaagguuggccaagauauaucaaugucaacaaagagagaaaaaaacuuuaguuugggcuaucaaauaccauuuaugaaucuaaaauaagaaccaaagucauuuaauauggauauauacaguauaaaugaaguaacugccucauaaaaucuuucacuauuuauaaauaaguuaucgucaugcccuaugugggugccuauacuaguggacuuuguugauccgcaacuuuauuaauuauuauuauuuuuugagacagggucucacucuguccugcaugcuggagugcaguggcuagaucucggcucacugcaaccucugccuuccggguucgagcgauucuccugccucaauuuccugaguagcugggauuacaggcacaugacaccacacccggaaauuuuuuuauuuuuuuauuuuuuuuuuauuuuugagacggagucucucugucgccuaggcuggagugcaguggugcgaucucagcucacugcaaccuccgccucccggguucaagcgauucuucugccucagccuccugaguagcugagauuacgggcgugcaccaccauauccggcuaauuuuuguauuuucaguagagacgguuucaccauguuggucaggcuggucucgaacuccugaccucgugauccgcccgccucgacuucccaaagugcugggauuacaggcgugagcaacugcgcccggccuuauuuuuuauauuuuuaguaaacacgggguuucaccauguuggucaggcuggucuugaauuccuggccucaaauguuccacccgccucagccucccaaaaugcugggauuacaggcaugagccacugcgccuggcugguccucaacuaucuauuucuuucuaucuuuuuucuuucuuucuuucuuuuuuuuuuuuuuuuuuuuuuuuuuuuuuuuuuuuuuugagacagggucucccucugccgccuaggauggaguacaguggcgcgauuucggcucacuguaacguacgccuccuggguucaagugauucucccgccucagccuccugaguagcugagauuacaagcgugcgccacuacagcccgacuaauuuuuguauuuuuaguagaggcgggguuucaccaaauuggucaggcuggucuugaacucccgaccucaggugauacgcccgccuccgccucccaaagugcugggauuacaggcgugagccaccaugcccgguaguccucaacuuucuaauuguaacuauccuucaaaguucugcucaucaaucuaaggauuacucuaaauauuccucuaugucguucaucauuuacaucuaauuauuauaucuucuuuaauauuuuucaaagccauccccuuccauucuugcuguggacaagcuaguuuucaaucagcuaaacuacuggaacaccuuauggucugcccuucugcuuuucucuauccuuuugcucucuuagaauuugaauccuauuucaaaguucccucuucucugaagcuauuucagggugcaguccuuuccguacuacccagaaucucaauuucuucuccauuccuguagcauuuacuaaaccauuaaucaaaaccuaucauaaacuaccuaccugauauuauuuaccuuuuuuuuuuuuuuuuuuuugagacggagucucgcucugucccccaggcuggagugcaguggcgagaucucggcucacugcaacuuccgcuccuggguccaugccauuguccugccucagccucccgaauggcugggaccacaggcgcccgucaccacucccggcuaauauuuuuuguacuuuuaguagagacgggguuucaccgugucagcaaggauggucucgaucuccugaccucaugaucugccugccucggccucccaaagugcugggauuacaggcgugagccaccgcacccggcccguuuuuuuuuuuucuuuuuuuuuuuuuuuuuuuuagacgaagucucccucugucaccaggcuggggugcaguggcgcgaucuuggcccacuacaaucuccgccucccugguucaagcgauucuccugccucagccuccugaguggcugggauuacaggcacgcgccaccacaggccgcuaauuuuuguauuuuuaguagaaacgggcuuucuccauguuguucaggcucgucuggaacuccugaccucgugauccacccgccucagccuccgaaagugcugggauuacaggcgugagccaccgcgccuggcuuuuuuuuuuuuuuuuuuuuuuccugagagaaucucacucugucgcccaggcuggaggcagcggcgcgaucucggcucaccgcaaccuccgccucuucgguucaagcaauucucugucucagccuuccaagaagcuggauuacgggcucccgccaccacgaccgcuaauuuuuguauuuucaguagagacaagguuucaccaucuugaacaggcuggucuugaauugcugacuuucgugauccauccuccucagccucccaaagugcugggauuacaggcgugaggcacggugcccgaccuauuauuuaccuuuucguggacauguccuauuagauuguaauuuuuuaaagcauaguacucauacuuuaauuucuccacauaguggcucuagcacagugcuuuuaauguaauggauacagaagagaucuuguaguucauucagguucauauuguucacucuucucugaaucacuucuaaacuuauuuuaaguauauauaaagugucaaauuauguguaaaauacuuguuuucuaauuauuuucuguggcucagauucaucucuacuucaaaacucucaaucucuuuagguuagacugccauuuuccuuucauacuuuucaccgguauacuucuguucucauagacagcauccauuauuaauauuugacaauaaagaauuuuuuaugauaaauauuuaaaaccuuagaaaugacaucccagaauaaaacuauggcccucugacuucuaauauuuuucucacaguaacacaaagggaaauacuggaagguaugguugucauuuaacuacagcuaaaugaugcuuuagagaggccagcaggguaacccaggcagucaagcugaccagugggaaucauagucacacggaggaugaauaaacccaaucucauaacucugcuccacccaacugcugccaagagaagauaugggaucaauguugccagcuuaucaucugauuuuuaaagauaagcugaaaaucuagauuuuuuauauaaaagguccugaauguuagguauuugcaacuaacucaagauaaaacaacaaugguguggaccaaacaaagcacuucuaaagucaagcucagccuauaugcuauuaaucuauaaccucuguuuuaguguuuaugaagugauuuuuuucuuuacaauauacuaucaauuuuaaucuucacaaaaaaaauuuuggguugaacauuuugcccaccuuuuacuaauggagaacuccucuaaaguaaugaagucaauaaaugaugaagucaggaacucaagccacauaauuuaucuccucauauuauauagccuguuugucuuacauccacagaucuuaacuuguauguauguguauggggagcaguauuaggagaugagagacaaucauaaauccaucccuaugaaaaccugaugaaaauuauagaccaaucauugauccucuccacagaaaaauacauauaugaacauacauaucaaauacuguacaaucccaagggguucacaggucccugaagacuacauagaugccuauaguauaugagauuaucugcaagagacaaauguaugcaaaauaucuuuagcuuuacuuaaugauaaacaugaauucauaaucaauaaaucugccaaaacuauucugaaucuauuuacauuucuaauuauucuacuguuaggauuaauaaacucuacucuuuauuacccauuauaucaagcaguguugucuuuuguccucacacacuuuuuuaaaaguauauaacuuccgaguuucaagugguugaguuccagaauuaaagaauuugcugauuaaucucauauucauacuuucuguaugcuucuaaaugucaaacauauucucuuccaaguugcuaugauuccagacuaaauaguucauuucucaguucuccuugguuuggaaacccuaccaccaacuuuaccauuuauuuauucucucuggauuucuuucaucuaugcaauuuuuucagguuuacaauggaauuacuuauuauauugcaugaagaguagaaaaccauuuucuacuuuguauuuaauaccuuuucugccaauguuuaucgcuuuucugauuauuuuaacuguaacaucacauaaugccaauauuuucauaagaauccacaauuauuaucaucaguuuauuuuccgggauuugaaugaauucaaccaacuccaaaacccacacugcucauuagcucaucauuuaaggacacaaaaaaguggugucauuuacaaacuuaggauuucacaauucauugccuuaucuggauauaaauaguaaaacuaguacuacucccaauucaaaauugauucuaguagguccuguuauugaaacucuucuacccgguaaagcaccuguugcuaagcauucagcuuaucguugauagaacaucccaugcccuuccuaccacaugccagacuaucuuuuugauaguuuuuauugcuaaacucugauaaaugcuguuucaaagucugacuaaauuacauucauuagcaccccucguacacauaugaauauaacucuucaacauuaauggugacuacuauuuauucucuacccuguggcaaauauuguuccagguuguuuaugcuaucuuauuuaauccuuacacaaaccaugaaauguaaauauuacuauuaucuuuuagccauaagaaaacugagguugagagcuuagagaauguucccaaagucacauuauauauauaggugguggagaccaggauucacauccggguuugccugaagucuuauaucagacaggcagaauugcuccuguaaauaaaggcagaauauuacuuucucuccaaugacauuggcuugaggguugguuauaaauuaggucccccuuaucugcaugaacaucagcuucauacuauucuacaauuuucaaaccucacucugaguucuuaagagugaggauuacauuggaaaugaaccuguccucaagaauaauaaacaguuuuauuuaaauaaaucuaaaaugauucugugccauuaccacaccugcuucaacaacaacaauaaaagaaaauaaggacugaaaacuuuucuaauaguucugucuuccacaggacuaaguguguauucaaacauguauguuuguuuauuuauuauugucauuauuguuguuuugcuuauuuuuguuuauuuucauucugguagcuggaucaucugauccucugacuuucaagauacuggcauuuucagaaccuuuauaaaugaaaggcugugaaggaccugcaagauuauuuucaaaggcaauuuuuuauucauuuaaauugggauuugugcccuacauaagagaauauauacccaaaucauauagaaauauauucuuaagcaaauuuuuauaaucuuaagcccuuguaacuugaaaaauuaauauuaagacuauugcauaccugagaaggaagagaaaaggagagaguagauacuauuugagaaaaaggcauggaaaaaccagauaaagacgcauaucacacuuccggaaaaugggacugaagagagagaaacugcagagccagcacagcaccaucucaucguggggagcucuggaugagaaaguauaugauaaagaagaauaaacaagggacacuguugaagaguuucuguucacaaauaucucacccauuuauucuaccaauuggauguuaauuuugcuuuaaaaaaacccuuuuaguaaauauauucuugcaggguuaaaaccagugguucuucauaccuuuacuuugaguaacuauaacuaaauugucuacaacuuaaauaaacuuuugggagaauguaugcuuuaauuaguuguuuugauugaaccauggaacauuucagaguaaaaaccauaaaggucucuaaacaacccgagaacagaaugacugagaaaggcggaaugaugagauauuaaggaagggcaaggcuggggaaaggaagugaaaaaauacuuacaguuuuaccacagaaaaaugagaaguuauaauucagugaucuugaaguuuccuucccgcucuacaauucuaugacaguuguuaugcaaaaaacgaaugucuuacacauaaaaacuuauaugcuauauuuuccuuccuggaaucuauaucauccaacugcuaaagcaaaagagcuccuuuuucuacuccaacaacauaaaagagaauaauuuauuaaaacuaguuccagaggacauaaagaaaaccaaaggguagaaaucauagggagguaagcaucuuccaaauaaagaaauuaauaacacacccucgaauacuuugauaaucaguauuugauaacugagugaaaucugggguccaaagagauauacagaucauugggaugguugagaauuucucccuuugcaaagaacacaccaaauaagaacccucaucugccagaggugagaaaaagugaugaaaagagagaauauugccccaccagccucaaggcauucaaguuccccggcauucgguccuuagucccuucccauuugucaccuuauuauuuuccuguccaccccugcaucauccaccugucacgucugucuccacagucaccucuacagacuuuuuucacacuuucccuuccugucugcuggucucaacgcucucuguccaggguuuacccacauuugcucuacuccgauuccuuccaccgacccccuaagacuccgagcagguuagaggaucgcgcugccuccccccuccccgccccguagucuccaacaguguaagggguacugugggaacaaaacccagagggguuugugccucuucacccccaucccgggaggcucccccucuauccccggaugguccucacucacagcgcacaguguggaaggcgcagcgcggcugcuucucgaaacucuccccuaacuugagaacccgcucgcgacggucuaggugugagaaucccgcugcgcuauucauaauuacucuccugcuuugacuuuaacuccgccaccagcgcucacuaucugccaccucagccugaagcagcugcacuugaucccgccagccaagucaccc

SEQ ID NO: 193042 - RNA, 29200 nt, Homo sapiens
uucccuuacugagcuugcugagcuccggggcccgcggagcucgcgccaggcuccugggaaaggacggggaguguuaccggggagcagcugcuccauugugccucgaggccccgaucgggcuaggccgacggccucccucccuucaccuuuccucuccuggcgggguucggcggcgggcgagugacugcggccacgccugaaaggcgacucuccugugagugggccagaaggcgaacauggcggagcggggaggcuggcgggaggcgggaggcgggaggcgggaggcaguggcgcuggccugcggcgcguucggaccggcuguggggcggggcagggcggagcggagccgugcggcggggcggggccgggcggcggggccugguuuccucccucagcgccauuuuguggcagcgagacccacaaauaaaggggagcgcagggguugcggcgggacuaggagcgcggcggggccggcggcagagcuguccggcugcgcgguggcccggggggcccgggcggcagggcaagcagcgcggccucggccuaugcgaccgguggcgccggcgcggcuucugccuggagagguaggcgcgggccggcuggcgggagcggacgcgggggaccuccggggccugagggcugaugcgcagccgcccccggcggguaaggggcgggcagggcccgaaaggccacacgggccuggugcggcaccggucucucgugagccgcucuaccuucccgccugcggggaacacuuccgccgcuucgaggccauuuuaucucuguccuccguccccaaggcccggguugagaggggugcucuggcggccggagagaccggccacucacggaggccggaggaugcccuccccgggcugagcggcggcgcucguuuuuuccucgccucggggucgcccccuucaccucccuugggccucuccugaggaccuggcggcacuaacgaguucagcaaggaaaaaaagaaacauucguucccuacauuucaugucacgcaguaggauguuacuacguucucuuguagacuuccauuuuuaaaugaguauaagcauucugaggaaagaaacugaauuauugcagauuuuugugaaauccaagucuuaccuuggaucccugugagacaguuacuagauuuuuuuuucaccguuuuucauaagucuguguacacguaauggaaaagcccgaguucuuguuuugauaagaaagucacuugguuguuugaucccaaaggauuagcuuaacauuaucaaggacuagcauaacugugauuauguaaaaaaaacaaaacaaaacaaaaaaacuauuauuuagucugguagggaaauacuucuaugaguauguuacaauuggaaguuguauuugugccuauuuuaucuaguuuuaguuaauuccauugcuucggaagauaaguggacgucauagauccaucgcaaguucucguuuuuuggauuuuaaaauuuugaccauuaaguuuucuacgauagauaaacauguuguggacauuuaaaaccguaauuuaaaacuaugagcgaaaaaucuuuucaagauggauacauuuuaauucauucaaguagcaucugauuagccaagucggggaaagauugcaguccgcaaagcuggcuugugauaagguugagguuacauuuuaaggguuuggguagguguguuucuuacagugcuuuuauauguuaagguaucuuaagcagacacaugguuuaaaaguucaguauuuuuaguacuuuuucauuggcagaauuuggacaagcuaccagaauugcuaacuccuaaaggauaaaaguaauaauaauagugugucccaggcacugcuuauuuuuacauggcucuuuuaugucuagcuuuuccaauucaacguugagucauguuugcugaaaauauuuuuguguauuguuugucagaaauaagcugguagagaugaaacacaauguguaaaaagcccugugauguggagaugagcauugucacaauuuguacaguacauuaaagcguucaaggucucuuauggucuuguauguaguauugaauccccuugaauauauuguuuagcaguuuugaucauuauguauuugcuucuugcuccucaaaauuguacguuaguuaguagguccuucagcaaaagaagacugaagauaguauuuugguuuuauucuuguuuuuaauuuuuuuaguugucuccaacuuuucugccucuaaauauuuugcuucuuguaguuacuaagcuuaacacagaaaaacuuuucaguaucuccacaauaguaaacuucauuguguauuguguauaacaagauguuccaucugacuaaaauauauugcuguaaauauuuucugccuuugaagauguaguuaauagaauuuaaucuuuucuaagugcacauugaaguugccuuuuauguucauauuauguucauauuuuauuugaaaaaucuauagcauuuuuauugugcugaaagcauuaauauuugcagcacuuugugagacaggcaaaauuaucuuuuugcugacuuggaaacugcaagaguuaaaagacuugcuuggaaucacacauggcagauagaggauaaggaaaagauggccuuucaguuccucaucaguaccuugcuacuacagugucugcagauuggugucuuacauucagcuaugauuuguucgccaagguaccgugucuucuuacugaaguuguuuuggcuggcgcuugccuccguucagagggaacugaguuaccuaacuuuaugaugcuaagagccaggaagguacugggaucugggaugcuaggcaccuaaccagucuagacugaacuccauacuaagcuguuuuucuguguuaaggcaucaagaguagauggugguccugauuuucugagauauauuaucucugaauuaucuacauaaauaacugaaacuuuuauguaauuuuaaaacuagucaaucauguuaccacccuuuugaggggcaccaaauuugagacccuuacccccaauuuauuaauuaauagcuguuuuaaucaccuaauagcugaucaccuaaugacuaacagucauuuucauccuggaaaaugggaacuaacuuugacuuugaaaagugcuguuauuaaaugugugauucauaagaacugaacauauuuucuuuauuauuuuccuucaggauucaacuuuaauugacuccaaaugauguuauggucauucuguuuuucugauacgagaauagauuguucugagaaccuagaauauucauugccuuuaugaaucuagaauugacuuuaaauuuagguuauuguguuugucauuugcgcuaaaaaaaaaauugcccuggggaauaccaaacuucucgguacauucguguggugugaaagucaaaauugccaauuagguucuauuuugaccaaauaguugaauguuguagacaguuguaaauuuugaaccuguucuaauuugccuuuugccagauggcgcauuuaacuuuguggcauaucaucgacuuucaaggaaagauuuacuuuucaucagauuaaaguugaggaaggauuuucuuucuaaauacugaggcucugaauuucccaaguuggauaccccagacagcuagagugaucuuaaaagugacucugagaguugacuuaggaaguguagacauuuauccaaaaucuguauuuacuccugacuuacauuacaaauacagaguuuuauuuuuaaagaaaauuucaauaaaaagcaccauuuaauuaaaaucuacucaccaucaaacuuuuuaaaaagaacauaagccaaugucaggaguuggagaccagccuggccaacauagugaaacgcugucucuacuagaaaaaaaaaagaaauacaaaaauuagcugggcaugguggugcgugccuguaguuccagcuccuugggaggcugaggcaguagaaucgcuugaacccgggaggcggagguugcagugagcccagaucaugcccgugcacuccagccugggcaacagagagagacuacgucucaaaaaaaagaaaaaaagaaaagaaauuucaauaauugcaggcugggcaugguggcucacaacuguagucccagcacuuuuggaggcccaagcaggaggauuccugagcccaggaguucaagaccagccugggcaacauagcaagaccucaucucuacuaccaagaaaaaaaaaacaaauuagcugggcguggugguucaugccugugaucccagcuacaaaggaggcugaggcaagaggaucaguugagcccaagagauggaggcugcagugagcugugaucgagucacugcacuccagccugggcgacagagugagacucugucucaaaaaaagagaggaaaaaaagaaaauuuaaguaacuucuguuuagaauccuaaauauuggagaugccaaagaauucugcaguaaguguuagaaacagucgggaggacaguaugauuauuauccucaaccuguggauuaucucuucagguuuuucaagaaacacugagucuguguuuuugauggggagaagaaacuauuaauuaaaugcccauuuugugccaguuaccaugcuaaagauuaaugucugucuucagaaauagcacaguauuugggcccugguugugguaauucuuuuugagauggggaaacugaggugcagagauuuugcuacuuuuguauuugcaaaguugacaaccuguuucagaauaccaagguuaucagaacuuucuucauguguuucucaguccuuuuaaugcccuuuaaaaacagauuaucaucucauuuuuugcuaagcuuacuguuaauuuuauuuuaguggaauaagaauauggauaccugucuuuaagaagagaguaagcaaguaaaccuagggaaaguaucagguuguagaaccacauaccgaugauccuugccaaaauccuggcauaggaauuugaacccugguguaugaaaagucugcccuuugcauacucagguuucgcaucccgugaaugcuguauuuuugauccgaguacuguauuuuuuaaucugaguuugauugaaaaaaauccaaauauaaauggacccaugcagcuaaaaccuggguuggucaaggaccaacuauaauaacuuuuauaagcuggaauuuauauugaacagcauccaugauacuuuaguauuacaacuaaaguuguacauacugaguagguaggaugccuuaguaacuagauaaaagguauaccaccuagccauagugauaaauauagcuguuuucaaacugucauucacagaucucuaccacaguaccuguuacgugaaguuccugguugguucucaaaauuuuauguucguauauacauagauacagauacugauauaccgguuaaauauguacagcucaaauagcuaaaauugucuuuaagauuuuuuaaauuaaaaauauuauuggccgggcgcaguagcuuacaccuguaaucccaacacuuugggaggccaaagcagguggauuaccugaggugaggaguucgagaccagccuggucaacauggugaaacuaaaaauacaaaaauuagccgggcgugguggcaggcaccuguaaucucagcuacucuggaggcugaggcaggagaaucgcuugaauccaggcgguggagguugcagugagccgagaucgcgccauugcacuccagccugggcaacagagaccgggcgcagggggagggggagugucucugucugcuucuuucucucucucucucucucucucuguauauauauauaguguguguguguguguguguguguguguguguaaaauugauauuuagcuccagacaaaugggaaauuacaaggaaaugccagauuugauaucuggguucuaagacuuugcagccuaaugcaugugucaugcuaaaauagaaguaguuagacauguggaguuaaauauggugaugguuucugagaugauuaaaaugacugccaccagguuaagguaguuacaaagcagcuuucuguaauggcagcagagauaauaaacugggcaacaagggaggaaccaauuuaaagaaaaaaagaauaauauacauuuuauaucauaguaauaugguuuaugucuucauaggacagagugacuugcucagugaaacagacuguauacaauuagcucagaaacaaauacugagguuuuuaucuguuugcuguaucccuugagaaagauuaaagagggaaggcagggugcaguggcucacgccuguaaugccagcacuuugggaggccaaggcaguuggauugcuugcgcccaggaguucgagaccagccugggcagcauggcgaaacccugucucuaccaaaaaaaauuacaaaaaauuaacugggugugguggcacaugccuguagucccagguacucgggaggcugaggugggaggaucacuugagccugggaggucaagauugcagugagccaucaucgcaccacugcacuguggucuaggugacagagcgagacugucucaaaaaaaaaaaaaagcccagcacgcuggcucaugccuguagucccagcacuugggaggcugaggugggcagaucaccugaggucgggauuuccagaccacccugaccaacauggagaaaccccgucucuacuaaaaauacaaggaaguuagccgggcgugguggcgcaugccuguaaucccagcuacuugggaggcugaggcaggagaauugcuugaacccaggaggcggagguugcggugagccgagaucgcgccguugcacuccaccccgggcaacaagagcgaaacuccaucuccaaaaaaaaagauuaaacagagaaagaagcaagccaguaaucuaagaucaauuuaugauuuuuccucuaaauucugcuuucuucaacacaauuuacuuaaucugaaaaccaggguuuaauaacaguaugauuagaauguuucauuuauaaaguggaguugagauuguacguaguauaaaacaugcuguuggaagauuaucuccuuuugaggaaucucaaaaucaagugggagaaaucaaguagucuugguguguguguguuuuguuuguuuguuuuaaugagagacagggucuuaccacauugcccgggcucgguucaaacuccuaggcucaagcagcucuccugccucagccucccaaagugcugggauuacaagugugagccaccacaccagccucaaguagcuuucgagaugaugccacagcacuccagccuggcaacagagugagacuccaucucaaaaaaaaaaaaaaaaauucaguuuaacauaccaagcuuuuggucaaauuucuaguaguuuagaauuuauaauaaguauggguaauuaaaauaaaccauaaacacuuuaaaguaagggaagauucaugaguauacuauuagaaauaauaacuagggcugggcgugauccuuccacagguaguucuagcuacuugggaggcugagaugagaguaugacuugagcccaagaguucaagacuagccugggcacuaugguggguccccaucucuuaagaaagaaagaauaggaaaaacuaaauuaguauaagaacuaauuacuuaauuuguauaaguuaugaauaugccaaaugcaauuuagaugcuuuuucaaaagagcacugguacucagaacccugauucaauuuuuuaauccucauagaauuuuuauauaaagauuuuauguuugucagguuagcucuucaugucguauacuuuuuuuuccaaccuuguauuuuaaugugguguuuauguuuauuacacauuuuuucuuugucuuuuuuuuguguguggauuuguaguuuaaugaauaauaccugcuauuagcauucguucuaaaaaacagcauaauaaaguguucccuacuugaauucauuaaccuaucuuugaaacaggguuaagugaauuuuguauaauaaagaagcuaauuuugagauacaaaauauuuggcauaaaauuaaauacuguaggaauauuuuuauuaaggugugacauacauguguaugugaguuuuuguuguuuguuuguuugagauggagucucuguugcccaggcuggaaugcaguggcgcgccaucucggcucacugcaaccuccgccucccagguucaggcgauuccugccucagucucccuaguagcugggauuacaggcgugugccacuacgccgggcuaauuuuuuuaauuuuuugguagagaccgaguuucaccauguuggccagacuugucuugaacuucugaccucaagugauccacccaccagccucccaaaaugcugagauuacagucgugagccaucacgcccaaccaguguaacauauauuuuaaaauauguaauaggaugggcguggugguucauuccuguaaucccagcacuuugggaggccaaggcggacggguugcaaugucaggaguucgagaccagccugaccaacacggugaaaccccgucucuacuaaaaauacaaaaaugagccaggugugguggcacgcaccuguagucccagcuauuuagggggcugaggcaggagaauugcuugaacccuggaggcggagguugcagugaccugagaucgcgccacugcacuccauccugggcgacagagugagacugugucucaaaaaaaauaaaaauaaaauauauaauauaucuaaaaaacuauugggcaguaguaaauuauggcugugguagguacuaccuuacuuuaacaacauaaugcuauaaaaggaaagacuuaaacugguauuacccuuuuauagucccuuagcaacaugcguaggauacuacuugaggucauuauauuucucuucacccuuuauggcgacaucaaaugauuugaauggcugaucagcuuuuuuacgagggaauuuguaaaaacuacccaauaacucuaaugauggaagauguuaacaaaggaagaucuggguacagaguauauaggaacucuguaauaucuuugccacuuuuuuguaaaucuaaaacuauuuuaaaauuguuuauuuaaauucuaauuauucaacaguaauuuaguucacuaauaaauugauuugaaagagucaguauuuuuuauuccuacuuucacuggaagaaaauaaauugaacuuguuuuccgcaacuuuuuuuuuuaggauucaagaugaccaacgaagaaccucuucccaagaagguauggguuuugguuuuggguuuuuuuguuuuguuuuggguuuuuugggggcuuuuuuaagcacuuuaaaaaaaaauagacuugaagggauuaucguuguuugcuuauuuuucauuucuuugccuuuauaacaauaauagcauuggaguuguacagugugccagauauuguaucuuauauccaguauauuuuuuagaauauuuucagauuuuggaaaacuuuaguuauaauaauauucccauggucuacucuuaauguucauuaugugaauauuuccaggucuacucuuaauguucauuauguaaauauuuccagguacauauauacaaauaaugucaaaaauggacauuaugaguauauuauuauucuuuuccuaguguaaaucccuuugauuguaauuaaaaacuacuuuauuaaaaaaaugguuauagcuaauuuucaaauucuaccuuuuucucugaaguuuuguugucuagucucaaaucucccccuguugugcauuccuaccuugaguuuaauuacucuuacauacacacacauacacacacacaguggcuguuauaaaagagguaacaucgucucuaggaggaauuugugauucaauugggaaagcuuacuaaacuuaauauuuaagugaauaauuuagauauuacagaaguuuccuauuguggagucagauuacucauuaaaugaauaaaggauuguauuaugcuuucauaaucugagaauuacugugugcucccucugguacccuuugauuuuccucccuuggaacagggucuugcucucuugcccagguuggagugcaguggugcaaucuuggcuuacugcagucuccgccuccugggcucaagcgaucaucccaccucggccuccugaguaucugggggcuacaaguacgugccaccacgcccagcuaauuuuuguauuucuuguagagaugggguuuuaccauguugcccaggcuggucucgaacucccgggcucaagagauagccaccugccucugccuuccaaagugcugggauaauaggcaugagcugccucuggcagccuuucaauauguuacauuauaauaguucccucguuccauuuuaugguaauacuauuuuacugguuaguauuauaauuugaaacauuuuuaaggaaaaaaauuuaagugucuuguaagggaauacuaauaaagccuuuauuuuauuuuuauuuuuuauuuucugagacagagucucacucuguugcccaugcuggagugcagugguacaaucuuggcucauuguggccucauaccccagcuuaugcgauccucccaccuuugccccccaaaguagcucagacuacaggugugccacuacgccuggcuaauuuuuguauuuuuugguagagaugggguuuugccauguuacccaggcugaucuugaacucccgaguucaagauauacucccgccucagucucccaaagugcaggaggcaugagccacaaugcccagccaaagccuuaauuuuauacugagguaggagagguaucucaccuuuacagccuuuauuugguguagugaauauacuguuucucaauuuuugaagcauguuagcuuaugcccuucuuucagcuuuuuguuuugaaauaauuauagauucauaggaaguugcaaauaaauguacagagagguucugugcaacuuucacugagccugcuucauuguuaacaccuugcgugacuagcagacaucucuaauaacugugaaaaucagggaauugacauugguacaauccacagagcuuauucacauuucacguuauacuagcacuguuauugggggaaguggggaagagcuauaugcacuauuaucaugucuagcuuuguguaaccaucauuaaucaagauacauaucugaacuaucaccauaaagcuucaucgaguuauucuuuuauagccacaucuaccccgucccucuccaugccugaccccuggcaaccacuaauuuaucuccauuuguauaauuguuacuucagaguguuauauaaauguaaucauguaguaugcaucuuuuugagacuauuuuuuuuccuuccacuuagcacaguuuccuuaaggcuuauacaaauuguuucauguaucaguaguccuguuucuuuuuauugcuuaaaguguuccaugguguggcuguaugauaguucaaucauuugccuguuaaaggacauuuggauaguuuucaguuuuuuagcuuuuacaaguaaagcugcuugcauguuuucauuucuuugagauacauguuuaagagugcaacugcugaguuauauggcacauucauuuuuaguuguauuaauaaaaggaacugccauacuucuucagauaccauuuuuauauucucaccugcaguguaggaaacuucaguuucucugaauccucaccagcguuugguguugccacuaauuuuuauuuuagccauucuaaucaguguguggugauaccugggguuuuaaugugcauuuuccuaaugaugaugcccauuguuaagauaccaaauaguuuaccuuaaaaaaaaaaaacuuuuguaauaaaauacuuuuucaaaaaaucauaauauguacugagccguuuaaaucucacacuugggagauguuucauaggucucauuauagaacuuugugucuucaggaagaacacuaaauucauauuguaauucucuuuauagguucgauugagugaaacagacuucaaaguuauggcaagagaugaguuaauucuaagguaaaauguucucuguucaaaaacaaagucuuucuauagaacauuauauugugacucuacacuguaauugucuuugugccagauauuguuuuuaauguuguucuauccucaaauaauuuaauguacuuuuugagcauacuaugaccuauuucuuauauuaacaccgaggaaaacguaacacuuuaaagaacuacuaggaagcuauaaguuuaacaaauauauggcuuguuuuguguaguuuuuccuuucguguuuaacauuugaaaaagaaauguaauccuaaaagaugcacuuauauuuauggaagaaauacauaauuuacuaaugaagugagguuacuuuuucuuauuagugugaccuucaccagcucauauaacuucauacucuucauuuucucaucuguaaguugaagagguuggguuaaguuauuguuaaaggugacuuccaguucugaauuucugcgguuaucuuguaaaugucuuacaaaagcagauugucaaguacaacguauaaucuuuuuagauuguguaagaaaucaggaaguaggauguucuguguuuuguaauuuaaauauauucuuucuguauuuuauugcuaugguuaguaaguuucuugauaacuuagauaaaaauaaaauaaguauuuuaacaggcugaaagcggaggagagaaaagauguuuugugagauaggcuaacacagauuuuguuguuuccuagagugugacaauuuccuacuuucaccuuuggacagcuacuguauuaugaacacacuuuuuaccuuuuuuuuuuuuuuuuuuuuuuuuuuuuuuuuugccauaaucucauacauaggacaguuuccauugcauaccuuugucuuucugcacauaaaauuuaaauuuuuguuauucuaaaacacuucugucuuaugcugaaguauauacuuaagauacacuacuacucaaugcuggguuuuuuuuuguuuguuuuaaugugcauauaaauuauaauagaggugaggugcugcucaggcuggucuugaaugccuggccugaagugauucucucaccuuggccucccaaagugcugggauuacaggcaugggccaccaugccuggccaugauuuuuuuuuucccugucucuggcauuguauacuuuuuuuaaugccuucuuacauaauugcucugguuagucugugcagucauuuuuuugauuuaacuguaggaggggaaaaaucaguaaucuuaauaaagaaucauagaaauguuuuauuuuaagauaccuuuaagguuucuaaaucauaugcaguguauuuccuugaggucaguuuaacaucuuuccuuagggaauucauguaagacuuuuaggcgaguuuuuucucuuugauucccuuggagauuuuaaaccagcugcuacuuauuuaacuagucugugccuucuauccuugugauauacauguucuugcuucaguuuuuauauuuuucuguacuucuaaaauaaaucguucuuuuauagccuccacugaagaucuuucucuauacauccccaaauauuugguaaacuacgugucuuagguuguaagugccguaaaaauaaagcauggccuuggcugaacaucaguguuuacauagaaaguggauuaguuugguauuaggaagguuuuuuuuuuuucuuuuuucuuucuuuuuuuuuuuuuuaagacagagucucgcucugucaccaggcuggaaugcaguugcgcgaucucggcucacugcaaccgccgccucccggucaagcgguucuccugccucagccucccaaguagcugggacuacgggcaugcgccaccaugcccugcuaauuuuuuuguauuuucaguagagacgggauuucacuguguuggccaggauggucuugauuucuugaccucaugaucugcccgccucggccucccaaagugcugggauuacaggcacgagccuuuuuguucauuauguuguaauauuaauaacucaugacaagccuguuuuuaagauuauaaaaugguuuucuaaagccaaauuuuaauuaauuguaccugaagagcagcuugaaaacauggcucuuaaguaugcaggauagcagacauucagggcagggugcuuuccauuaggaacugccuaauaagacuaggaaaaaucuuuauugcuaagaggaccuagcaguguauauauucaggguagagaaguauaaugaagaacaacgguccccuuguauucugauagcauauggcauuuaugcagguuucugacaguuagaugugauuguuaaauuacagucuugaaaaauguuauauucucccccuguguuuacaggcagaaauugauacuaccuugagaagagucacaugguauuuucccaaaagagccaagauaaagaaccuucaauucuacauaaugaggcacauuucuaauaugccuuuuguucuaaguggacaacauaugaaagcagcagugggauuuuuuuuucagcuucuauaauccaggauuauccugaacaucagugauaucaaagugaaucugggguuugaucucacccagggcaugcuuggcauguucucagcagaaaaaaccuucucuauauaucucuuuuuaccuguuuccuguaaaaugggaaggaauaaugagggacuauuuuaugaucaguuaaacuagauuuaggcuggguguggugacucaggccuguaauuucagcaguuugggaggccagggugugaggaucauuugagcucgggaguucaagaccagccugggcaacguagugagaccccaucucuacaaaaaaaugagccaugugccuuuggucccagcuauacaggaagcugaggcagggacaucgcuugagcccagacccuguuugcgccacgcugcacuccagccugggggacagagcgagacucugucuaaaaaaaacuagauuuaaaaugaaaaauccagaagaaugcucaguauuacuaaaaucugugaguuuauagauaucuucuaguuuauuuaauaaacuauuuuaucguaacaacuaauguauggauuuuuuuuuauuagauggaaacaauaugaagcauauguacaagcuuuggagggcaaguacacagaucuuaacuguaaguuugaguuuuagcuuccuaaagacugaauaaucuccuuuugauuguuaaaaucaaaaggauaguuguuuuuauuaaagcaaauguaauuuuucucguguuuuauuauaagaacuguacauaggcacuguguugggugcaagaaaauauaaagaugaaugagacacagucucagucauuggagaagacagagguguaauagucauguaauggcaugacuuagcaaaauuauaugcaagguucugaauauagaugcaguaacucagaacuacuugaaacuuuucuuacuugucccuaaccccuucugcauaggaauuugacuugaagcaugaguuacuagucuagaagagaaauaaacagaagcaaccaguaacagauuuaugacagcuuaaaucaauauauauaacuuaauaauauauacagauuuuuuuaaaucugcugaaaauaacguuuaucauuuuaagccauuuuagucucacuuuuuacuguuugaaucacauacuauuuguugaguauaaaaaccaauauauauuguuuuguaacuucagaaggguuaauacccugaaauucuaauuuugcgugacuguguuacccauagaagucaugaacauugugaaaguuuaaggcuaggcacaguggcucacaccuauaaucccagcacuuugggaggccaaggugggaagaucacuugagcccaggaguuugagaccagcauaggcaacauagggagaccuugucucuacaaaaaaaaaaagagucaggaggaucacuagagcccgggaggucaaggcugcugcagugagcccugauugugccacuggacuccugccuggguaacagaauaagauccugccucaaguuuaaaauacaaauuguccagcaguuauuacuauuuuauuuauuuauuuguuuguuugagacagggucucgcacuguugcccaggcuggagugcaguggcacaaucugggcuuagugcaaccucugccucccagguucaagucauugaccugccucagccucccaaguagcugggauuacagacaugcaucaccacgacuggcuaauuuuguauuuuuaguagagacgguguuucaccguguugguuaggcuggucugaaacuccugaccucaggugaucuaccugccucagccucccaaagugcugggauuacaggcgugagccucugugcccagacagcauuuuuauauuaaauagguuaaaacauacuaaucaggauuuugugaauacuguauaacacagauguuuucugucuucuguugggaguagaugaaacuauaaaaacauaauuuaguuaguagucauggagcacuaugacaccauugucuccuaaaggagcucucgugaccaggaagaaauucgccuguuauaaaaguaguuaggauggaaacuaaagacuugauuaauuuuuugacccuaguucuuauuguucuugacagagguauuuagaacuugaucuuaaaauuguauuuauaauuuuuuuuugaaucaucagcuaaugauguaacuggccuaagagagucugaagaaaaacuaaagcaacaacagcaggagucugcacgcagggaaaacauccuuguaaugcgacuagcaaccaaggaacaagagaugcaagaguguacuguaaguauuucaaguuauauaaaugucuuuaguugaggaauugguuuuuaguccacauuauuacauguuaauuuuaaacauuuaaugcuaaauauaagagcuuaucuuuuauagguacguaugcuuugagcuuuaagaauacuagaugaaaaauuuugauaaugucucauuuagacuguuuuuuguggccaagaaggcaaaguuuuaaguuuuuuuugaaauuuucaugccuuauaaguauuaguucaucaauuccagacauuuuucagauaucuuggugucugaggauguaaucaauaaaagaacauuugcucuuuauugcuuuacuuucacugauuaggaaagccaucugaggacuuuaucucuguucucuuguccccucuguguauagaacuguuuuuccuagugucagcaaccucuuuagugucuccuuuuuaauuguuagaacuuugauguguacuguguaguauuuacuaugucuacguagaucugaaaucuagugacauaauugaucauccagcucugguaguuuaggcucaaucuuacgguguaauuauacaaaauaauuagaggcagcuguauccuuguuucugauuuuaaaaucugaauguuucuucaauucuuuguguacucucccuucauuugguacauauagaagucuucuuauguguuauuaaagucuucuaagauaguauucuggucauuggagacaccaaaaaucuaugggcacaguccuguucuguuucuuuugccaauagaauguuccuuaagguucagucacaguccuuuuacuucccuuacagagauuguuuaaauuuccacaaaagcacguauuuacucuucuuucacuuguuacuaaaugacuucuucacauuuuacuuugcuaaaggcuggcuuuuaucauuuucuuuacuuuuuuuucccacuaacccccccgcccuuuucuugagacagggccucucucucauccaggcuggagugcagugguguaaucacaccucacuucagcuucccgaguaacugauuucaggugugcgccaccaagcgcagcuaauuucuuaauuuuuguagagaugaggucuucccuauguugcccaggcuggucuugaacugcuguacuuuggcaauccuuacuccuuggccucccaaaacuguugggauuauaggugugagccaucgcaccuggcccauuaucauuuucucuaccuucuuaacacauuuuguccuuuuguuucuaucaguuuuguuguaauucuuaccaccacugauacuucuuucuccauaguuacuaaugaauguuuuaacaaauuucccuuuacacgagaaauggaucuuaccuuuagacugcuagcacuugggagauagagugugaauagaagguguugaugguaauaucucauaggaucagaaugucuugaauuccauuucucuuccggauuccuacucuugacaucauaguugaugugugcacaucacaauguuugugcuauucaugcacaucugauucuccaucuguccuauaugcgcuggcaguuuugaucauauuacgccuggucaaggccuucggugauaccucaucacucuugucuccucgaccuggauuuuaagguuauuucaacuauaauggaaccuaaccuuuuccagcuuuuuuuuuuuuuuaaaacagcugucaccugcauacgccagcugaacaacuuccuguucuuccaauuauaauacaagugagguuuugcagacagggcagggcagcaggagcaaaaucacaaggaaaggucaagauuauauauggcagaugaggauaaaguuucaggugagagugaaaaaagaugaggucagccuggaaucuuggguauucuagaagagaggggacuacugaagaauucuucagcaagagauguaugugauggaucagauuuagauuuacauuuuagguagaucacucugacuugaguaugaaagauagauuugagaggaacaggacuuuaagcaggaaaaccaauugugaggcuguuaaaauaguucagaugaaauacaugaagccacuggugguagcagacaggacagaauagguguuuuggaggcacaaucaauaggacuuguuuaguuuggaugcuguuguggaaggaaugaaaaaaaucuagggaggaaucacagcuucagguuugucuuguuugacugaguaacgaugcuacuaggauagauccuacaaagaucaaauuuuaaaagaagaguagagugugguguuaggaaaacaggaaauccagcauucccuccuccuuccccaaaauacaaagugauuaaaacaaaggcauacauaaaguucuguacaauacgaauuuaaaauuguucguuagauuuggcaguuaagagguuguuggccaaggaagccaaaagauuggauaccccugcucuagaggaacugucaagugggaagugagagaaacuaaauuuaaagaguagaaagaaugggagugauguacuauaggaguuuggagggaauagguuaagcgaaugguugaaaggauuggcccugagaaggaggguuucuuacccucuugagugaaaaauaguggaaagguuuguauuagguaccuguccuuuaaaacagagcugcugcauuuacccuugguguuucaaauuaagcuaagcuuagaaaaaauaaaauauacauccuuaggaaucuauuuguguagaucuuuuguuuguccagcauacuaacucauccauuugaucuuuuaauaauaaugcuuuauuucuuugucuacaugcagucuuugccaaguacaucaguagucaauuuaguuaguuuugagcguaaggcauaaauuagccacguaguuacuauauucuuaacuauauacuguauucuuaacuauauuuuauuuuguugguaaguaaaaucugucauuuuuguucaccucagugguauuucuguuuuucauuuagucuuuugccaaucaacucaaaauagauuuaggaauaaaacuaacuuugaaaacacuuuacucaguguucucuucccuagaacauggaauuuauucuagucugauucaccucucuuuucaugaaugaaaguguugacuauugggucuuuguaaagcuaaauaguaacugagucucagucagugcuguagacuguuuuaaucaguccugucaguacauggagugcacuguaagucaugguuuauucucgcucuguuaucuuagcagcuggcuucacauugacuaugcaguuguacuagauuuuugcucagugaaacaaauauauucccaaaccacuuaguauauuuguuccuuuuacuaaauuuauauuagaaaauuuuaacuguaauccuauuuaagccuuaguauggaguuagaucuugggccagaucuacuuugaguaugaagaaaaugaugaauuuaaugcuaauaacuauauuucauauuuuagaaauguauuuuuagugugcuaguaaauagcacaacugaagucgaaauugaagguuucauauguaaguagaaggguucugguaugguggaaaaagcucuagacugggaaucagaaggccggagaacuagaauuguagucccgcuauggcacugaacuaaacaguuggguuauuuaaucucaaaauaagcaguuuggauuaggugaguuacuuuccagcuuuacaauucuaugauucggaucuauucagaaggggaaaaauaugaauuauacuuuauuuuggcuuaagguccuauagaguuuugcuuuuauaaagcuguaacagcaacucuuguagcuauaaguacuguauauuuuuuccuuuagaaauucaaauguguauuuuaaguuauaaucuugcaccugauguauuuuuaggggacuuuacauagaauaauuuccacagguaaaaaauuaagcaaaccaaagacuucauuaacucuuagguaauuaauauuuuaaacuuugcuuuuuuccacuggguugucagcauuuuuaguaaauauaauguugauuuucguuuguuuuuugguaauguuuggauuguaaaguaaaauguauguagccacuuuaagucccagauuuggagauguaaucaaauggccucaauuccuaagugaguaaccuuaaauaguuauuuuuuuaauugacaaauaaguuuuuuacauauucaaggacuacuacauagugauguuucaauacauauaauguauagugaucagaucgggguaauuagcauauucaucaaauaguuuuuagucuguacuuuuucuagaaaguuuuaagauuuuucuagagaauuucaggaucaaagaggggaggagcuuaaugaaagaguugguaaaucaagugaauggagggaguuuuccccaccuucuuauguauguuuccuuugauuuggucguaauuguuucuuuugcuuugcacagacucaaauccaguaccucaagcaaguccagcagccgagcguugcccaacugagaucaacaaugguagacccagcgaucaacuuguuuuuccuaaaaaugaaaggugaacuggaacagacuaaagacaaacuggaacaagcccaaaaugaacugagugccuggaaguuuacgccugauagguaaacaaaucauacuccccagucaagacuucccugacagucccacuacgagaaagcuguggugggacagccaaguacucguuuccacaccaagacucagacuuuuugagccaaaaaaaagccacauucuuacacuguccagcuuguaaugguuaauguaaaacuuaccagaugaaccuuguguuucagcuuuuuucuuuuccccuuccccuugcuucagaggccugauggcgucggacuauuccgaagaaguggccaccuccgaaaaauuccccuucuagaacauguagacacuugagaaauguuucuguuugaagaaaauagagggagaaacagaagucuuaagucuguggcacacugugucuucagacaguuugaaggaaugaaaaccuagagauuuuaaaucaugaauugaacauguaaaauuccaguaaaauguaaaaacggaauaugcaucgcucuuaaccuugagcauagugacuuagagacacuguguaucaguuuugccaauaagacuguggacuucaugauuguuguugaacuucugggucaaaacucaaaugaggugaauuuugccuuuaaaggguuuauuugcugagaaccaacuuucaauagucaugagagaaucaaauaauagauguccguacaaguagcgcauauauuuaaccauuuaguuuggggcucuauauuacuugcuugagccuuaaucaaugugguuuuauucaaugguuuguucuuugaaugguugcaaaaacuguagauaaucuuacugaggacuguacaaacaugaaggugugguaucaaacuucagguugaaacuguuugaagcauuauaaacauucauuucacaacuagauuguauaaggauauuagcugugaugagacucacugcauuauuuuuuuuagugaauuuuaugaaauccccguuccauucaacaggcacauguuuaaaagagcuuugucguugguguuaaugggggaauguguuccuucauuguauuugggccuuuuguauugcacucuugauauuaaauuaaaugugccuugaaauaguugguuuuuuuuuuuuuuuaaguucaaagaauauuaugaugauuuuguuguacucuuuaacauuuuaauuuggggcggggagggccuguugagagcagauucauuuuggaaauacuguugcugugcucuucaaagugaaggaaaaggcgcugugccucauuuuuaaaagaccuacauaaaagacaaggagacuugacacuuguuacuuuuaugacacuuugucccaggguauugcaguagaaaguaaugugggacagcuucacagggugucugccagaagauaauguguuggaacugugggcuggccuaaguaagacauuuugugaauugaaaaaagguauagugaucauuucuagcaaauucauuuaaucauuuagauaaaugaggcauuauuuucuucaugcuuccauccaauccuggaggugaauuuuuuccgucagaucauucuauaagucaccaauucaaauuuucgcuuggugauaauggagucuaagaugaguggaagauaaauguuccagcuugucccaacguuuaagugcaguuuuaacaagggugacuuaaguucucucuuaaucauucaaaucaauuguaaguaucauauguuugugcuuuagggaacugauuguggggcagaggguggguugaagaagugguuugugugacuuuucagcaagaaaucugcuucuaaaauucucacuauuugugaggguuggaggguaaguaaccagaucuguuugaaauuagcuuaugugcuugcauuaaggcuuuuguaaauauuuuaugccauuuaaguucacaguagaaauggccuaaguaucuuuuuaguagauuuuaguagaagaguaauccauaaaauguauuauuaacauguacucaaauugagcaggcaucuuucuuugacacuuagauaacagucaugaguucuaugguuuuuuucuugucauuguuaaaauuuucucuuuuaauaagauaauacaugcuuauguauaaaauugaaauacuguagagaaagggggagaugaaaagugagugucacucccggaugugaccuugacauccucauucucuucuccaagagcaguaacugcuauuacuuuuucuuggguaucaucaagauaauuucuaugcauauacaguuauuuuauguauauuguuuuaaacaaaugugaucauaccauaaacacagaugaguugcaccuuguuuuuuuuuacuuggucucuuuggcauuuuuccauuuuuuaauguaucuagacaacuacauuuuuaaugcuuacauaguauauuuccguuauauuaaggaaucauaauuuauuugaaucacuuauaaauggauuuuuuucuauaaaauuggcuguaagccagaguauaucagguacuauaaauacaucacuaauuugaaacaaauaauggcucaggcaaucccgucuggaauauuuccagugguggaauggguuuugcuuuggguugcgugcacgcgcacgcacgugugugucuucgcuuuacuguuuuucuguucuaauuuugaggaagaaagauucccagaaauaaccuguccaguucaguuaaaauauuucauucaugugagaaugcacacauuuuagaguguuuagagguauaucuuucaaagugcuuucuauuauguuuguggguuaaucgauuuuaggaauggguugauuuuuuuguuuguaauuuuaaaaaauuauuucaaaaacaacuacuuguaauuaaauuauuuuuucaaaacugugauuuuguuaaaauuuauuuuacuaaucacuaguuuuaaacgugauaugacuaucuuagcuuagacauuuauuuauuaaaagguaugacuuuuuaaacgaaaccuuuuuugcauuagaauuugugacauuuuuauaugggguuaagucaggucacagauuaauguaucuuacaguugucuuuuucuacucuuuaaaauucauauaguaagaagguuaguuguaaacaccaaugaaauauauauacuuugcaagaagacaguuuugagagcauaggcaguaaaguggaaggaauuccauuguuuuugacaaucuugcauaucucucauuuucccauuguuuaauuucuaaguggauguucaguggaggcuaacgccugagagugcugaugggaaaugguggaaaucuggagcuacaguagcagugaacaagaacaccagcuaauaaaguuaucauaucaaagaauaaagccuuuaccacaugcucacugguggcuuucacccucgggcuccucugagcaguaguaacccagguugaacucuucagguauuuucuggaagaaagcuuaauuacaaacuuuuccuugaauuacauuagguuagaaaacaugcagccaggcacgguggcucaugccuguaaucccaacacuuuggaaggcugagguaggcagaucacuugagcuuaggaguuugagaccagccugggcaacaaggcgaaaccccaucucuacuaaaaauccaaaauuagcugggggugcucgugcacaccuauaguccccagguacuccggaggcugaggugggaggaucaccugagccuggggacgucaaggcuccagugagcugagaucacgccacugcacuccagccuggcaacacagugagacccccaucucaaaaaaaaaaaaaaaaugcuguaggugaaagaaccaugcaacacuucaaagauugauaaaauauuuacaaaaugcucucauuuuuaaacuuauaaggcauacugaaguaguguaucaggcaagugaaagccucacuagaagaaggaaagacuagaauuuaaaaaauguuuuaacccauaaggucauccuggacuuaccccaaggacaagaaugucacacugucuuuauccaagucucaaagguaaauaucacaauuauuuacuuagaucccuuuaaaagugaucauuucuuuuuuuuucuuuuuucauaaauaauuacaagaacaagcaaauaauuucuccuuuuauugcugaggcuaaagaaaagcaguaaaauuuuauugggaaacauuugagcuuuucauuacauauuugcaauugcuauguaugugcacauagguucaguaguauguugcacuagcauuuggaaacuauaaucuguggaaagugugacacuccuagauuggcagauauuugcguguuugaauugugauacgugaccacuggucuuauuuuugugucaaaaggaugaucuuuuccaauaaagucuuaagucuuuaaaaaaaaaaccuuaacugcugaaugugccucaauuaauauaauagauaauauucuugagaguuauggaagauggauguaccagaaaacuucccucucuccuccucuuuuuugagacagggucccuguuuccgaagcuggaaugcaguggcauggucacagcgucaaccacuugggcuuaagcaguccucucaccucagccuuuccagaggcuggcacuacaagcaugugugccuggcuacuuuuuaaaaaauuuuuuguagaguuggagucuauguugcccaugcuggaggacuuccuguuaaggaaaauccuuauuaaauguuuuucuagcaagaauaaauacucucauucauuuuuauuuguagguacugauuuucauaaauauuugugauugauguugcauguaccuuuucaagaacuuuucugauaaagcgcuagauuccuuaguguaauaauacugguauagccaagguguguguuaauuaacuggcucuguuuccauuucaaaugauaauuugagaugaaaauagauggauuucagaauugauuauugauguaauagaaacaagguguagcuguuugggcacuuuuuguuuaggguuuauuuuuacugcuguguuggcaaaauacugaaaugcagaagauggaugugucccagaaaagaagaugguaauuauggggaagcaucugcugugauauaguuauguuuguauguguuacaucuaucacuguaauaauuguaagcaaagacagagaguuuugucuucauuuugugauggauggcucuuuccuuugcagccaaacagggaaaaaguuaauggcgaagugucgaaugcuuauccaggagaaucaagagcuuggaaggcagcugucccagggacguauugcacaacuugaagcagaguuggcuuuacagaagaaauacagugaggagcuuaaaagcagucaggaugguaagggguuuguuucuuuuuggaacguugucucaacuuugcauuggcuuuuuaaaacugccagucaugaauauuauagguuagauucuguacauuguuaaccucugcccuaugauuguauauuauugugagugaagcauuuuuaguugaguccgcaaacaaagccauauaauuuuaguuuguuuauccccacccuccuaauucuuuauuguucaaaauuucuuacauuuuuguuuuuaguuggggguaggauuugguaaaagauaaaaggguguuguauuacuuaacaagauggacaaauuuguauucauuguuugaaagggagaauaagcauuucucguuaaguguaaaucuuagaaacaugggcaguuuucagcgaucugaaaguaauaaaguugauuguaucugugaagguuuuauuagugaauaagagauuuaaucuuuaaauuugcugagauaaaacuugucagccuccauccuuuuuagugcaaguguagcuguaucucuguuucucuucuuuguaaggugcauuauuaauaaggaaaauauccaaauucuuugaaauuuuaaauugaaaauuagugucucugguuaauugcaaagaugaucaguagccaaguaauuucuucugaacuaccuaccuuuucaaaaucuucaggaauuauuuccugugacuuuuguccuuuuauauguaacaguccuugguugagaacaugggccucuuuggaguguuauagaggaccacacuauccuuaaggaucagacuugcuauggaacuaaggcacuggaucaggaauaaggggauuggccauagugggcccauagguaaacgugagucaaacuuuggggcuguaaucaggcauauggcaagauggaucaaaacaauuuuaacuugguugcuuaauacaguugcccucgguauccaugguggauuggugucaggaccucccacaguaagccccucauauaaaaugaugucauauuuacauauaaaccuauguacaucuuccccuuugagccaucucuagauuaacaguaccuaauacaauauaaaugcuaggaaaauaguuauuuuacuguauuguuugggggauaaugacaagaaaaaaaaucuguacauguucaguauagacccaguuuuuucuuccuugaauauuuuccuucuacaguugcuugaauucauuguugcauguggagggccaacuguauauuauuuuaaguaucugacuucccccaaaacaaacucagucauauuuuaagauuccaagcaaaauuuuuaaauguagugugauuuuagaauuguauuuguuuacuugagcguuuauugacucccuugcuuuguggcaggcacuaaagaaacauuuuucaauguuauaaacgauauuaaaguuggucugacucuccuuugcacagaacugaaugacuucaucauccagcuugaugaagaaguagaggguaugcagaguaccauucuaguucugcagcagcagcugaaggagacacgccagcaguuggcucaguaccagcagcagcagucucaggccucugccccaaguaccagcaggacuacagcuucugaaccuguagaacagucagaggccacaaguaaagacugcagucgucugacaaacggaccaaguaaugguagcuccucccgccagaggacgucugggucuggauuucacagggagggcaacacaaccgaagaugacuuuccuucuucuccagggaaugguaauaaguccuccaacagcucagaggagagaacuggcagaggagguagugguuacguaaaucaacucagugcgggguaugaaaguguagacucucccacgggcagugaaaacucucucacacaccaaucaaaugacacagacuccagucaugacccucaagaggagaaagcagugagugggaaagguaaucgaacuguggguucccgccacguucagaauggcuuggacucaaguguaaauguacaggguucaguuuuguaauauuuuuucagcaaauuuuuauacagugucauuuaauuugggagaggauacuguccagaaaauuaaugcauacuuuugucacaauuugccuuuuuguggguguacguuuugguuuuuuuuuguuguuuuuuuucuuuguuuuuuuuuucuuuucuuuuuuuuuuuuuuuuuuuuuuuuugcuucaauacuucugccgcuuuggaaauuguaacaguuaauuacuuugaauguugcuaaaaggacauuuuguguagggucaaguuauuuuuauaugaguuaaugugaaauuguaaauggaaauuuuuccuuaaaauacaacacaaugaugucuguauaaaucugucuguuuagaaucugugcuguguaagggcauucguacucaugcuguuacuguacuuaugcaccauucagacuuguuagaguagauguggguuuaugacugccaaguuugcccaguacaguaguuuuuuaucacuaaaaguuggacucauugauggaguccuguaguaguuucaguguuagauacaguuuuuuccaccauacaucugugcauuuucucuuuaggugacuguuuaagaaauuugugugcauaguuacucaguuuuuaugaacuguuguauccuguuaaugcauauugcucugugacuccaguauaucuuaccuguacugaccaaaccuaaauaaagauuuuuauuguaacuccuuaa

SEQ ID NO: 193043 - RNA, 14205 nt, Homo sapiens
uugaugguugacagauucuuuuauuaacagucaaaaacuucacacaauuggaaaauaaauguuucuucaaugaauaaucaaacaaaaauuauccaggaccuuauaggguuuucaguauguaccaggcuugaugcacaucuuagaagacaggacauuaucuugcugggaucauuaggguaugacugaaagugagaaacaguaauuuguaaaacauuuaccuaauaauagcuuucccaaacaguacuuccccuggaauuaaaacaggaaauacaauuuauguuuauacgugguuuuagauaugacucaauauacauagauuuuaacuuuaugguuugguauuacuuuuuuaaaggcgcucaauagaaauucaaaucucacuuuaagaccaugaauuucaaguugcaaugaaguguacaauaaaguugugauuucucaacaucaaaguuuaauuauuacaaaauaguucaagcaacagauagaauuucaaaaacaguauuugcuuugcuuccuuguuuugcuccaacacuaaucaugcugagguuuuugaagcacagcuaugacuagggcaggcacugcugauucagucacaaaaacccuucuuggaugaacaauacuuguucuuuucagaagaaaagcaauuuuaccuuuucuauuucuauuaugaaaaacagagcuaaacaauuuuuguauuuuuaguagagacaggguuucaccacguuggccacgcuggucuugaacuccuucaaguguucugccugccuuggccucccaaagugcugggauuacagaugugagucaccccgcccagcccuaaacaaucuuaaagucuccuuuuccaccagaugacuaaaaucuuuaguuuguaaauucccuuagucucuuaaaaucaaucuauccagaagacaagaaagacaaacuuagugaaggaaagaaugcuuccucacucucucaccagaaagccaaagcaaaaauagagccccacagaaauuucaacauugaacauuuuuuaaaucuuaaagcuuaguaggaaucaaaaagcuuuauauaagucagcagaucugcaaaccuuguuaguucaauacaaaccaugaucuagcagacaacuuauauucaaaagcucaucuuucaaaagguuccaccuugcccgucuauuuaaacagucacgaccuuccuuagagaggcaagcaguaaucuuacaugacacauaaaagcuguuucacugugacacauauauaaugaaaaguaaucagucuccaaaguuuuuccaauccacaagcaugcauacacacacacacauacacacaccgcuuugguacucuugucucuaauaauuuuuaaagccuacuuuucuaacugaauuuuaaaaguaccuugaauuuaaauuuuuuuuaaacuucagucuucaauauugaaacugcuaaguuaccccauuuuuccaugaaaaaaaaauagaaaaauaaacuuggggaaaaaauuaaaaauaaaaaauaaacuugggaaaacauuacuaaauagguuuaagaaaaaagccuauauaggccaggugcaguggcucacaccuguaaucccagcacuuugggaggcugagccagacggaucacuugaggucaggaguucgagaccacccuggccaacauggugaaacccugucucugcuaaaaauacaaaaaguagccaggcaugguagcaugcaccuguaaucccagcuauucaggaggcugaggugggacaaucacuugaacccgggaaguggagguugcagugagcuccggucgcgccacugcacuccagccugggcaacagagcaagacucugucuccaaaaaaaaagaaaaaaaaaaaacgccuauauaaagaaaauauuccaauaggagauaaaccuauguacacagaguugcucaccccagcauuaucuguaguaacaauuagaaacaaaugaaauauucaaaaacaguaaauuaggcagaugaugaaacaacauggcaaauguaugaugcuaagccaaauauacaaaaagaucccugugagacggagcagggaccccucuuuggggugugccagggggauucccacaagcacagaaauaaaggagaaucuugaguuuccuucaccgaaaacuccaggcacccagcucgccccgagaaggaaaccagcaagcugauaagcaagaaggucauaacaguuucaaacaauagccagggaaguuagagucaccuagagacauccuuaacacgugccccugagcuacuuuucagaaacccagacccccaccaaauggauucacacagacgucagauaagggggaacaccagggacuaaacucugaccuccauucuuugcucucaguuucuuccugaggggccuggccagaccuuaauguuccuuucugcggaccccaaguuuuuagacaaagcuuugcuuccuuaaccaaucacaaaucagggagucuuugaauccaccauaaccuguaagcccgcccccugccuaccccacuucaccuuucaggccaaaccaauauauaagcuucauguagugauuuacaauuuugguauacagccauaccacccugaaggcacccgaucucgacugauuuacaauuuugccuuuaacuucugcuuuccugaaauuuaccacugccuuuaaauacucuagcuuguaggucaucauggagauugggucucaagcaugagcugcccaauucuccuugcuuggcgcccugcaaauaaacauccuccuuucuccuacugcaaaaaccaccuuuuugcaguuuugcuguugaaguuugccuuuacugugcaggugagcaaaccccaguucaguucaccugcuacauuuaaacaguauacagcucuauuugcaaaaacuauacaggaacauuugaccuaacaaaaaccacugggugacaucuaccagaaguaucacugcagaggauuacucgacaaaaagugcaauuuucuauagaaagccgaguguuucccuugggaaaguguuaauauuuuauuuuuaaguaacuggggcaaaagacuagauuuucuauaacugcaauagaauaggacuagaaaggcaucccuacaaguccccaaaguauauggauggaauauuuuugaugguuuuauaaaugacaauuguaauuuagcucucugaagaaaauguccaaucagauucaaucacacaaagcauuuacuauuuucaaucacuugcccaauaacaaaauguuuaguaagaaauuauucagaacauuaaguuguuuaugaaauaagugacuaagcaacaucaagaaaugcuacaauagagcagcuuacuguauucugcaguacucuauaccacuacaaaaacagucauaaagagcuuaacauacucagcauaacgaucgugguuuacuuuuugcaagccauguaucuuucaguuacauucucccaguugauuacauuccaaauagcuuuuagauaaucaggccugacauuuuuauacugaagguaguaagcgugcucccacacaucaauccccagcaguggaauaaggccuguuagaaagaaggggaaaacaaaccaaccaucaguuucagucuaaaacauugcaucuucucaauuucaacuuuuauuauucuacucacacaaaauuacccuuuguaacaaucucauucacuuguuuuuuuauauaaguaggaaaucuagauaagaaugaauauuccuauaaaauauuuuuaauucacuguuuacaaagaaaaugugacaaauacuaacaauaaaauagacuugggaaaauuaacaacaguacuuuaauagcuauucuuaaaaauaccaacaaauuaauucaagagccaauucccagccuuccucaugguggucuuaggagcagcaggaaggguggguuacaucugugggagcaggcaaaagcccacugagaaccuccuccaaagggucugggcacucacagggguuuacgaggaaccagcucugcuccccaaggcuaauuuuaaucuuugggaauacagagcaguuggaggacacaguguuuucagaaauuaagugagguaaaugaagaauuuaguucuaucuguaaaacauccauuuaaaaaaacuuuuggucugggcgcaguggcucaggccuguaaucccagcacuuugggaggccgaggcaggcagaucucuugaggucaggcguucgagaccagccuggccaacauggugaaaccccgccucuacuaaaaauacaaaaaauuagccuggcgagguggcaggcgccuguaaucccagcuacucaggaagcugacgcaggagaauugcuugaaccugggaggcggaaguuguagugagccaagauugcgccacugcacuccagccugggcaacagagugagacuccaucacgcacacacaaaaacacucaaaauaaauuauagcucucucuacaaaaacaauucuuaaccaguaugucuugaucaguugugagggaggucacuaguaauuuauuauuaauaauuucaaguagcaaaauuuauuaaugauuuuuauaaacaaaaggccaugacauucccucauuuuccuucuaaugugcuuuccacagggagaggaaggaguguagcugggacucacuuacaaauaucagccuuucuggucaugcagcucuacaaauaaccugacucuacagaucggugcuuacaaauuuuuuguggcuuuuacaaauuguuaugccaugucacugucccaaaagagcuguucagauucugccaaaaucugggucuauccugugaagugagccacagaucaagaguauuccaaugucagggguagaagaaggggcagagaaugacuguuguugaugugaagguaucacuuuaaguucaaagucccaacccucugccagacaacucauggcucuauuucccauacucuucagugacauuuuuuaaauccaauuaggcucaacagcaaaguauuuggugagcccagccuggcacuuccaagccgaauauuuucauauacucuaccaaagagccccagaaaggcagaaggucuggaaaccugagaucuagucccaguuuaaccucaaaugcucagcagaggagguaacaguacaagcucugaaaucagucucugcuuguauuucuuuuccucacucuuguucuauagcuaauuuuuuuuuuauuuuaguacauauaauuaucuaagcugauauuaauucucuguagaaugaagcaggguuaauaaguaaaacauuuggcugggcaugguggcucaugccuguaaucccagcacuucaggaggccgaggcaggcagauaccugaggucaggaguucaagaccagccuggccaacauggugaaacccugucuguacuaaaaacacaaaaauuagcugggcauggugguaugugccuguaaucccagcuauuugggaggcugaggcaggagaaucacuugaacccaggaggcggagguugcagugaaccgagaucgcaccacugcacuccagccugggcaacagugagaucugucucaaaaaaaauaaauaaaaauaaaacauguuuguuaauguaccuauaaaauuacguguacuuaauuuuaugaaauaucaggacuucuaaaacauuuuuacuuacacaagacucuggguguuaucuguuaagauuugcaaauuauuacauguucuuaaaacacuguuaguuuuccuuauuucuaguugaaugcuuuacaguagagcaucucucccaaaugaaaucacaauuuuuaaaucuaaccuguuguuccuugcaguggauccugauuuggacaagcagcaauuuguaaguguccccguuccuuauugaaaccaagccaaccccaaccugagccuuggacaccaacagaugcagccgucagcuucuccuuaaacuugucaaaggaaccaaagucacguuugauggcuuccagcaacuccccuauuaaaaaaaaaauccaaaaccacccacaaaugaacagauuucaauaauuacaguaaaauguuauauuacauguauuaaaauauuuuugucauagggcccaagaaauuagacaacaucagaaugcgacaccuggaucuaaguuucacaauuuuaauucacguuuuuguuuuuuauaacuucaacuuuuuuuuuuuuuuuuuuuuuuuuucauuuuuuaccuuuugagacggaguuucacucuuguugcccaggcuggagugcaaugccaugaucucgggucacugcaaccucugccucccagguucaagcaauucuccugccuuagccucccgagcagcugcgauuacaggcacgugccaucacgcccggcuaauuuuguguuuuuaguagagacaggguuucuccauguuggucaggcuggucucaaacucccaaccucaggugauccacccgccuuggccucccaaagugcugggaauacaggcgugagccaccgugcccgguucaaauuuuauuuuaaauucagaggguacacgcacagguuuguuacacggguaucauaugaugcugaggucuggggugcaauugaugccaucacccagguagcgagcuuaguauacaacaguuuucaccccccguccccuucuuucucccucccugcucuguccucagugucuguugcugccauuuuuauauccauaaguacuccauguuuagcuuccacuugcaagugagacaugugguauuugguuuucuguuccuggguuaauucgcuuaggauaauggccuccagcugcguaguucacauuuuuuaaugaaucguguuagagggauuuccccacucacuguacuaucuuuguuaggaaagaaauacuacuuucuguuagcuuuuucuuuucccugaauagaaaauuuuccuuugacuucuacccuccuucuucuacgccuccauuugggaauaaagucauuguucuucuccaaggcagcccagcucuuccugucuugaugggcaguuuucucuacgacugaacuaaggguauacuuuaagagcuguaauccuuuuauucuguaguaauacagaauauaauucuagauuagucacaucaacuaaaucaacugggucaaaaucucacuucucuuauucuacggguuuaaaaguaaucaucuuuauaagcacaaaugauggaaugugguacagauuaaacaaaaauggcagcauaccaaaaccacugguugcauaugaauauaucugauauucugguaacugacaaaacuucaaaaguauuaaccgauagucuagaagacugaacucagaaaaaaaauaaguuggccaggcacgguggcucacaccuguaaucuuaguacuuugggaggccgagacagguggaucaccugaggucaggaguucaaaaccagccugaccaacauggagaaacuccucucuacuaaaaauacaaaaaaauuagccgggcaugguggcaggcaccuauaaucccagcuacucgggaggcugaggcagagaaucacuugaacccgggaugggcagaggcugcagugagccaagaucaagccacuucacuguagccugggcgaaagagcuaaacuccaucuccaaaauaauaauaaauaaaaacaaaaauaaagaaaaaguugcccaguuucccaagcuuacucuccucauucaucauuaccuuaaaaugaaauugcuuauuucaagugcauaagauaggcugccuuccauaacacugauuaaaaaugaacaauaaaaccacagaaacuuagggugcauauccggagcccagaaacaagagacaagaacuacauuuacgccucaugcccucccugggugaagaagauaauuaaagucaucugggccuccacaagcuacacaggaagucaaggaaacagugauagcgaacaagaccaucuagcccuguacucuccucauucccugaacacuuuuuaaaaauacccagaaaaccuaauuuccuggaacaacugacuuuuuaucaguuaggaaagagugaaaaauagcaaaugacacuauaauuuaauucucaaaacaacaccauuguuaucccuguaucacauagaugaaaaaagguacagacgguuaacuaucuaauccaggcccuagaaacuaguagacagaaaguucaucuuuucuagacuggcgcgguggcucacauccauaccacagcacuuugggaggccaagguggguggaucacuugaggccaggaguucgagaccagccccgccaacauggugaaacccugucucuaccaaaaauauaaaaauuagccgggagugaugccacaugccuguaaucccagcuacuuggguggcugagacacaagaauugcaugaaccugaaaggcggagguugcaaugagccgacauugcaccacugcgcuccagccugggcgacuguaagacuccgucucaaaaaaaaaaaguucauaaaaugaagucucucagucuuucccuaauaugaaguaccauccagaaaccagaagguggaguugaugugauauucuauguuggcgugaacauaaaaucuuaugacauaaccccaugaaagcauucuccauuccuacuuguguccuuuugaaaguuacaacuuuuaucauacucguuguuaugaaaaauaugccacuaugauaccucugguaagaauaagguaacuuaggccaggcacgguggcucaugccuguaaucccagcacuuugggaggccaaggugggcagaucaugaggucaggaguucaagaccagccuggccaacauggugaaugaaaccucaucucuacuaaaaaugcaaaaauuagccaggcgugguggcgggcgccuguaaucccagcuacuugggaggcugaggcaggagaaucacuugaacccaggaagcggagguugcagugagccaagacugcgccacuguacuccagccugggcaacaagagcaaaacucuugucucaaaaaaacaacaacaaaaaaaacaaaaaacaaguauaagguaacuucaguaaaucaacaaucgauuccuacugugcacaaaauguagauaagggugcaccaauauauaccaaccuuuggguucuccaccaccguuagggcugagguuuguccagaaaaugcuaugauugauaugaccaccaccauugaacuucagugcaggcugaagagcuaucugggcuguaacaucuccugaaaaguuaaaaugcaaacacauuuuuuuguaacuccuacuuuuucaaccacuguauacauuauauuuuuuucuuuguaagcuauuagauaaugggaccagcuuaucuauaacauccguuuguccuaaaauucagcacccccccgccccaaaauuauuugucccagacaugcugaacaacugaugaaggaccuagcagagguggaaaagcuagaaaauucacuccuggcugcuaggcucagggaucucuuagauagaagagauuuuaggaaaugaaacaccaaagaggacaaucaaaauaauagaaugcuaaaauguauggcucaacauacagacuguacagaaaaccuucaacucucacuuucaagacagacgacgauucauugggaaauaucuccaagucacauuaacaagaaacucaacauacucaaaauugaacuccugauguucuaccccaaacuuacuccuccuauuguccuccacgucucaguaaaugccagcucugucccucaggacauccuugggaaccugaugucauuuuugacuccucucccuucaccccacauccaauccaccagcauauccauuagcaaagccagcucuaccuuuaaaauacauccaaucuauauaaaagcacacagagaaaaauaaaagaaaaaaauaaaacacaagcagaaccuaaucccuucucccuaacucuacugccaccucauugggacagaggaccaguauuucucacugcacuggugccacuauccccucaguuuuggggggugggggugggccuugcccccuccaaaggcuccccuucucacuggagcgaacccuagguguuuacacucagcuacucuuacuaccaagaggcgcugcacuugaccccgucauugagcacgugcucacgcagcugcagccucacuggccuuuuugcacucacaugaccaacuuggauguuccccucaaggcuagcugagcacugcugccucugcugaacacucuuccccaagacagucucaugcugcguuccuguuccuccuucaagucuccacugaaacaucaaccccaucagugaagccuucucuagccaccauacaugaauuagcaacucccugccaccccucccagacccuuuacuccuucucaauaggcccuguaacuccuggcauacugcauggguaccuugccaaauaaguaggcaaaauaaaauagucuuuucuaugccuucaagaagcuacagacuaaaugaacuauuaauauuagaaaaaaauggaaauccucuuguuuaauaaauauuuugugcauauuauccacaagauaccaagagaagcaaaguaaaggacacagagacccacugagagcuuugcucucaaggagcuuacauuuuggaaaaaguucucaacugcuguucugaaaguguacguuaagaacauaugucugggccgggugcgguggcucacgccuguaaucucagcacuuugggaagccgaggcgggcagcucucuucaggucaggauuucaagaccggccuggccaacauggugaaacccugucuucacuaaaaauacagaaauuagccagguaugguggcgcgugccuauaaucccagcuacucaggagcaugaggcaggagaauggcuugaacccaggaggcagagguugcagugaaccaagaacacgccacugcacuccagccugggcgacagggcaauacuccgucacagaaaaaaaaaaagaaagagaaagaaaaaaacauacauacaaggccaggugagguggcucacgccuguaaucccagcacuuugggaggcugagaugggcggaucacuugaggucaggaguuccagaccagccuggacgacauggaaaaacccugucucuacuaaaaaacccacaaaaaguagccaggcgugguggcguacgccuguaaucccagcuacucaggaggcugaggcaggagaauugcuugaacccaggagacggagguuguagugagccgagaucacaucacugcacuccaaccugcgggacagacugagauuccgucaaaaaaaaaaaaaaaaaaaaaaguaugucugacuaggcacgguggcucacaccuguaaucccagcacucuggaaggccgaggugcguggauaggggagcccaggaauucaagagcagccugggcaacauagugugaccccgucuguuuuuuuuagacagaauuaaaaaaaaaauuuuuaaaaggaacauacguagacaaugcugcuuucugaaacaagcuccaguuguuuagcgauucagaaaggagagaaccaacugauaucugaauacacagcuaaucucaaaggguuuuuuaaagacaccaacuuuuuuuuuccuuuguuagguuuacaaacaguuuuuuauagaucuguguuucccuuauuaaauuuucuugagagucacucuaaaaauagauguaacuuuucuauuguuuuuuaauaaaucaauaguaacugaauuuuuaaaaugggaaagauacaugcuuaaugagagauaauuuaauaaucuuaacaucuuacaguuugcuuacucauuuuaaaauuaauaaaaauugagggcuuaauaucugcuuuuaagaacacuuuucugaaauucaacauuuuauuugguuucaguuuaguuuuugccucaaauaauaauaaaagucaaaugcuuuuuguugaaaaauauucauauuagucaguuaaaugugaugagauuaugacauuguuuuaucuuuuuuccccaaguuuucaaacaugaaaaucuuuuuaauaauuuuuaaaauauguuuaaguaaaagaaagcucugcagguacucaaucacuuauaaacaauauaguacaauacaauaaaaagcuuuuuuccaguggguuguauuacauaaguaaggcucugauuccacaaguaaaggacugaaauuaaguuguuuuuaaaauacugaagagaaagguuccuggugucagauguugccuuacaggaaguacuuucacaacugggguauuccccagucucuccccauuacauguuucccaaauuuguuauuuccuaaaucacggggccuuuucccguaauucaagguucgucugucucaaguaaaucuuccagaaugugguaacuuccuccucuuuuaaucauuuacuucaaacacaaucaggcugaaauacugcauuuuuccacuagaugccuccagucaacaagaugugacugucuaaaaauuacucaacaaauuucauaaccccgaaauucaaaacauuuaaggaaaaguaaacauuuuuuacuacguagcuuaccaagcaauacagagagucuaaaaaacaugacuaucgauuaucuuccuugugcaaaccacuaacgaauaaauuaaaaagacaauacuauuuuguaaaaaacguuaaaacauaacauucccauacacacccccaaaaggcacagacucaaaaaguccacauaccccugguuuuaucaaccgagcucuugagaaaaaaaaaaaaaguuaacaacauauauuuuaauugcauuacaaauaugaguaaauaguaaauaaaaacaagccuguuucaguuucccacuaaagggcuauuuuccuugugaacuuugaccccuaagggaaaucaagaaaaguaucaagucuaaagauccugaacuguuccacaguuagguuacugcuuuuuugguaacgcacaccacaacggugugccuccuccucucccaccugaagucaagugggcucagugaaguuucaccugcaggguagcuggggaugcagggagucuccaaguccuaggcuggagucccgaccccguuugcucucaggaagaugacaaggaccaugguuccuagcacggaguaguguccuccugucucccaccuucagugugaccuggcaguaagacaccacucccacuucuaucaggaggugacccugacacucagagacaccugcggacccgaugaugucuggccaccaguggacaggcgcucucagcccuccugcaaacggcuggcacaccuaccugagagaccaaacauuuccccaaagcacauuauacaacaagaacaauuucaauuugcaaaaaaaacgagugacacaguagagcuuucuuuucaggcccuacaauucaccagugcuggcaauauguguaacggaauguggcucacaacaguaaggcaagcuccuucgcaggaccccaaguucccugagaugacagaaguguguucaaacccaucgaggcacuccuucuacaaugagguagaccauguguuuaaaagagagacuaucgugccuggaaaacucggaaccgguacaaauacgaagcgaguucuccuccacggagaggcccguccguauggggccuggcucccuggggucgccucugccggggacugccucccgccgcucagccuggaaccuacccuuggccaacgccuccugguacuucuccucggugacguucagguuguucacguaggccgcguggugcuugcuguggugcagcugcaugaucugcgcguugaugugagguuccagggcgccguagucguagggcaggucggggaggcugugcuucugccuggagcccagauaccccaaaaccggagccagcugccugcuggugcugaagacgagaaagcacagcccggucagucagcgccgcgggaccgucuacgcaggcugggcugccgaggaacggcagcgcgcggcgucccccgaguccccgcguccccucccugcggauccccgcuccagccgccgcgccgggcacucccgggagaaccgccugcaggugccccggucccgccaggcccggugcggccacugucgccauugccgcggaggcccugcccgccgcgagccccuucgcccuuggggccgugaccggguccccuuucuucucacccgcacacugcccggcucaacaugcugcuagugcuggugcuaccgcugaugccgccgaucugcugaagccgcugccgaagccaccacagccacgagugccgcuccugcgccgcccgcgggccuuaagaaagcgcggggagcagggccgcgaccccagcugcgccgcaagggcaccgc

SEQ ID NO: 193044 - RNA, 5883 nt, Homo sapiens
ugggucuguagacuguuuauuaaagguguguuaagggggcagccacuucccuccgugauuacagcccccagcguggguggaccuguguggguccgucuugggguucccucguugaacaugcugucaaaccaggacacuggcuccagcuuguguuucugcucuuggccaucgucugggaguggacaugcaggcuauggggguggggggcacuuagaaggagaaaggccuaaaacuggaaucucuugucccugaggcuggcucuggucuuugugucucucccaguccuucccuuuccucccccuggcgugguugguguggcuggcuagcugcuaacaauggcuugggucucagggcaacccagguccccauggugccuuuaagcagcaggcugggccaaguucucagccagggucucaggaucugggagacaggacagcacaggaacugccaagcacaagccccaaaaggagcccacagggagugggacccaucccagggaggggcgggaaaaagaggcagcaaccaggcagacucccaaaucucuuuuauugggggaaaugggccucuuggggguccucacugcacggcuuguucauuggcacugcuucccgaguccuggggcuucaucacaucgggcagcucuggcgggcuggaaaacggcucgaugcacagggccucaaaggugucaucuguggaggaagcagcagagcugcagggggguauuccagcucuugccccagcuggggccuugguguucacgugugaucaucugcagcuuuggggaucuccaugcgaacgccccuccacacggcuguagucuccacagcgcugaccucccuguuccagcuacccccguggccccacgguaaugucuccuaccccugugggcccaaccugaagguccccagcccuucccacugaccaugcuggggccccuuuccucaucuuccauguccacuagugagucugagggcucaccaucugcagccagcaucacccuucacccagaauauaucuccuuguucccuucacacacuuugggaggccgagacgggcagaucaugaggucaggaggucaagaccauccuggcuagcacggugaaaccccaucucuacuaaaaauacaaaaaaaaaaaaaaaaaaaaaauuagccgggcaugguggcgggcaccuacagucccagcuucucgggaggcugaggcaggagaaugacgugaacccgggaggcggagcuugcaguagcugagaucgcgccacugcacuccaaccugggcgacacagacuccaucucaaaaaaaaaaaaucaaacuagacuaucuagacuauuccuccccugcugaaaaccauccaguggcuucccaucaugaccugaauaccaccaaguccuugccgucugucucucccucugcuucccacgcucugaggcucuggcucucuauguucuucuguaaguucuuuccuaacucagaccuucgcacuugcuggucccagcacucggaauggcuggcugcuucuggacuuucaggguccaacucaggucaccuccucagaugaaccuccaguccacgcacccccaaaagucaagacauccugacacucugggcguaggggcacuuaccacuggacaaacugcccuuuugacuggcuccaggaaggcaaaggccuucccugucuugucccuacugucaccccaacacacagcaaacaaacccacagcuuuucuccugugcuuucuuccagcuaggagacccaucucugcuuggcucaggguucucaacugaucaggcaucccagggaaagcuggaaugccugaucacaguuguggcggucacaaauggggagguggggugccccagcgcuaucuaguggguagaggccugggauacggcuccacgugcuauggugcacaaggcaacccacacagcaauccagcccaaugugcccacugugccgagguucagaaacuaauccaucuuccaagccacaaaccugugacaauucgugccuucacuaccucccucauucuuuugugaugagccgggacaaugcccuuuaacauuugauuugaaauacucaucuccuugagugguaagcuugggggaggggagaggcggaggguggggcacccauucaaggccugggaacaacaugaugauggguugagcugcacccagaaguguguuucugcaagcauuccauggggaagcaaagagcugacagcccaugcugugcccccuaucaagacagccaucaccugcaagagggaugaugugaccugggcuccggagucaccaccacauuccaugccauauuagggguugugggagaaaaacaagucaccuuccuuagccuugauuuucucaucugcaaaaugggucuaucaguaucuuccaagucacagcaaaccucuagggguaccacuguugaaauuagagaaagggacacuucugggggaacacagcccagcuucgguucacgaagcagaccagauaugcucuuggcacucccuugcucucuucagacaggcaccccugggccaggcaccgaggcucaggccuguaaucccagcacuuugggaggcugggauguauggaucgccugaggucaggagauugagaccagccugacuaacauggugaaaccccaucucuacuaaaaacacaaagauuagcugggcgugguggcacaugccuguaaucccagcuccucaggccacugaggcaagagaaucgcuugaacccgggaggcagcggcugcagugggcugagauggcgccacugcacuccagccuagacaacggagugcgacucugucucagaaacaacaacaacaaaaaugcacccauguacaaggcacgaccugugucuaugccagcccugcaccugacucuuaacaucaccaucugggcagaaagagcccacagaaaggcucugaagcuucccaucuguugggcacuggcagcaggccagaccuggggugcaugaggacucaacaccaccuugcugugaagccagucucaucacaccccuuuaaggagaagggaacacuggggccaggaggggcaggagggcaagguagcuggccagaggauauagcugcugagacugaggccuagccugaacuuauggaacggaaagguggagcuaggacucuacucuuccucuucagccuuugcuauguucccuuacaggcagaaaaauaagaauuccuuacaacuuuauccaaguuuucucagccauccacacagcugcuggguccacagcugugaaaacacagcucuauaaccucucuucaaguuccuagagacaaaauauuuuaaaucuccccucccuuucucuuggguggaagaagauaucuuggcgaguaguaaaccacucccuaauccccagguuucuaaagcuugggcaggggugggguauggcugauggaagcccaggcucuggaucugaauccuagauguggcagucccagcagaugaccuaaccuccccaggcucacuuuacugaaccugaaaacuggcaaaauccaaaucucagccacacagagaugcagaggguuucggugauacauagcauagagccugguaugaugucugacuccagcaagggcccggcagucagcauccuaaccguggcucccuacgugacugcugguaagccuguguccucaucugcagaacacggaugaugguauguggacuucccagggcuacugagaggaugagacagggcaguggaagccacacacagaguaacaugcagagcacggagccaggcacucacucagccuccuguaaaugugagcuggcuucacaaaauaagcuuugguuucuguaagcaucucauuugguugcuucuuuuuuaaaaaaaaaaaaaugaggaaacaaacacauugugaaaggauauugccagcccuuuaggcacgaggaagacacugcccugaaggcuucaacuccaggcucccugaugaccuucuuuggaacaguguucccaaccugcuuggcuaccacccagcccaguggguggugggccucucaccugcccggaaggccagccccacuguggcuggggccuguggccgugcuguuugacuggugaagccacacucgcccagugucuugccaucauccaagaguuggucauccugaggagagaagcaggaucuugggagaggcccuacauggggcaagucccaaagacuucugaccagcaacuacacgggaagucagaggagggaagagagaguucccucaguguggcccaggaccaccacgcugcuugacaaauacacagauuccaggguuauauccaagaacuucuaaaucaaaaccucccagggugggacuuuagaauccgguuuuauccaaauucuccaggcaaaucuaauuugaggagccacugagcuaucuggagauaggcagaccuggcuuucaaucccagcucugucacccuggacuaggcauuugaacauuuuuuuauuuuagagacagggucucgcuauguugcccaggcaugcaguggcacagacccaacauaagcgcuaucauagcccccuccagcuuggaacuccugggcucaagcaauucuccugccucagccuucagaguagcugggacuacaggaccaugccaccacggcuggcugguaguugagccuuuugaugcaaaguuuccucaucuguaaacuaggaauuaccagaauucucaauucguagggccaccagaggguuucaaugagcuaggaagaaacauaaagcacuaaguagacauguggcacacgggacaugcacaggcacggucauuuaauauuugcuaagucccaguaguuaugagugaggaaaggccuuuagagaccaugggagcugaggcucugagccuggagcuaaaagucaguuucccaguuuccagcucuagaaucugaacaaugcacuugggcgacaaccucacaauguugggagacguaaaucagaggcugaugcaucugacuccccaaugcagaccccaaaccccaagccauucugacugaauaaucucaguucguuugcaaggggaaaggggggcuucuaggacaucagcaggaggucgggagguaauaacaaacgguugcuuggugaagaacgagugggaccugacuuucuuugcauucacugaguuccccacccuccacccgaaggaguguccggggggacagcgugauuccgaugggccugcgaagaaggguggggauuaaggggucgugguucgaacccuggcgcugccaaugaccuuuggcugguuaagcgaccaagccgaaccucaauuucgucaacugcacggcgcgggcgauaccguugcagggguugcaugccacggugcccucggcgcccggggcccggcacgaggucuaaacaucgcccccggaccggagauccccgcggcgagcgcagcucgcgcuucacccgcacaacggaugucccagucccgcggcucgggcgcccgcaggcgucgccggccgcuacuguuuacaucgcggacagcguaggcgucagccccgugcccggcgccggguacccgcuccccucggcccgcccgcgggacccaccuuguacagccgcugcucgucaggaggccgcuugaggaugcccucgacgaugcgcuucaguucgaacaccgugcuggacuccuuggcguccgugaagaugguggucuuguggcgccggaucaugaggaacacguccugggggcggcgggccggcgugagcacgaagcccgggccccccgcgcggcccagccgccccccgccgcccccggcccggcccggccgccccucccccacgcccgcucaccaucgcggcugcugccucuccccucgacgcgccggcgcagccgcgcuccgccccguuccc

SEQ ID NO: 193045 - RNA, 5883 nt, Homo sapiens
gggaacggggcggagcgcggcugcgccggcgcgucgaggggagaggcagcagccgcgauggugagcgggcgugggggaggggcggccgggccgggccgggggcggcggggggcggcugggccgcgcggggggcccgggcuucgugcucacgccggcccgccgcccccaggacguguuccucaugauccggcgccacaagaccaccaucuucacggacgccaaggaguccagcacgguguucgaacugaagcgcaucgucgagggcauccucaagcggccuccugacgagcagcggcuguacaaggugggucccgcgggcgggccgaggggagcggguacccggcgccgggcacggggcugacgccuacgcuguccgcgauguaaacaguagcggccggcgacgccugcgggcgcccgagccgcgggacugggacauccguugugcgggugaagcgcgagcugcgcucgccgcggggaucuccgguccgggggcgauguuuagaccucgugccgggccccgggcgccgagggcaccguggcaugcaaccccugcaacgguaucgcccgcgccgugcaguugacgaaauugagguucggcuuggucgcuuaaccagccaaaggucauuggcagcgccaggguucgaaccacgaccccuuaauccccacccuucuucgcaggcccaucggaaucacgcuguccccccggacacuccuucggguggaggguggggaacucagugaaugcaaagaaagucaggucccacucguucuucaccaagcaaccguuuguuauuaccucccgaccuccugcugauguccuagaagccccccuuuccccuugcaaacgaacugagauuauucagucagaauggcuugggguuuggggucugcauuggggagucagaugcaucagccucugauuuacgucucccaacauugugagguugucgcccaagugcauuguucagauucuagagcuggaaacugggaaacugacuuuuagcuccaggcucagagccucagcucccauggucucuaaaggccuuuccucacucauaacuacugggacuuagcaaauauuaaaugaccgugccugugcaugucccgugugccacaugucuacuuagugcuuuauguuucuuccuagcucauugaaacccucugguggcccuacgaauugagaauucugguaauuccuaguuuacagaugaggaaacuuugcaucaaaaggcucaacuaccagccagccgugguggcaugguccuguagucccagcuacucugaaggcugaggcaggagaauugcuugagcccaggaguuccaagcuggagggggcuaugauagcgcuuauguugggucugugccacugcaugccugggcaacauagcgagacccugucucuaaaauaaaaaaauguucaaaugccuaguccagggugacagagcugggauugaaagccaggucugccuaucuccagauagcucaguggcuccucaaauuagauuugccuggagaauuuggauaaaaccggauucuaaagucccacccugggagguuuugauuuagaaguucuuggauauaacccuggaaucuguguauuugucaagcagcguggugguccugggccacacugagggaacucucucuucccuccucugacuucccguguaguugcuggucagaagucuuugggacuugccccauguagggccucucccaagauccugcuucucuccucaggaugaccaacucuuggaugauggcaagacacugggcgaguguggcuucaccagucaaacagcacggccacaggccccagccacaguggggcuggccuuccgggcaggugagaggcccaccacccacugggcugggugguagccaagcagguugggaacacuguuccaaagaaggucaucagggagccuggaguugaagccuucagggcagugucuuccucgugccuaaagggcuggcaauauccuuucacaauguguuuguuuccucauuuuuuuuuuuuuaaaaaagaagcaaccaaaugagaugcuuacagaaaccaaagcuuauuuugugaagccagcucacauuuacaggaggcugagugagugccuggcuccgugcucugcauguuacucuguguguggcuuccacugcccugucucauccucucaguagcccugggaaguccacauaccaucauccguguucugcagaugaggacacaggcuuaccagcagucacguagggagccacgguuaggaugcugacugccgggcccuugcuggagucagacaucauaccaggcucuaugcuauguaucaccgaaacccucugcaucucuguguggcugagauuuggauuuugccaguuuucagguucaguaaagugagccuggggagguuaggucaucugcugggacugccacaucuaggauucagauccagagccugggcuuccaucagccauaccccaccccugcccaagcuuuagaaaccuggggauuagggagugguuuacuacucgccaagauaucuucuuccacccaagagaaagggaggggagauuuaaaauauuuugucucuaggaacuugaagagagguuauagagcuguguuuucacagcuguggacccagcagcuguguggauggcugagaaaacuuggauaaaguuguaaggaauucuuauuuuucugccuguaagggaacauagcaaaggcugaagaggaagaguagaguccuagcuccaccuuuccguuccauaaguucaggcuaggccucagucucagcagcuauauccucuggccagcuaccuugcccuccugccccuccuggccccaguguucccuucuccuuaaaggggugugaugagacuggcuucacagcaaggugguguugaguccucaugcaccccaggucuggccugcugccagugcccaacagaugggaagcuucagagccuuucugugggcucuuucugcccagauggugauguuaagagucaggugcagggcuggcauagacacaggucgugccuuguacaugggugcauuuuuguuguuguuguuucugagacagagucgcacuccguugucuaggcuggagugcaguggcgccaucucagcccacugcagccgcugccucccggguucaagcgauucucuugccucaguggccugaggagcugggauuacaggcaugugccaccacgcccagcuaaucuuuguguuuuuaguagagaugggguuucaccauguuagucaggcuggucucaaucuccugaccucaggcgauccauacaucccagccucccaaagugcugggauuacaggccugagccucggugccuggcccaggggugccugucugaagagagcaagggagugccaagagcauaucuggucugcuucgugaaccgaagcugggcuguguucccccagaagugucccuuucucuaauuucaacagugguaccccuagagguuugcugugacuuggaagauacugauagacccauuuugcagaugagaaaaucaaggcuaaggaaggugacuuguuuuucucccacaaccccuaauauggcauggaaugugguggugacuccggagcccaggucacaucaucccucuugcaggugauggcugucuugauagggggcacagcaugggcugucagcucuuugcuuccccauggaaugcuugcagaaacacacuucugggugcagcucaacccaucaucauguuguucccaggccuugaaugggugccccacccuccgccucuccccucccccaagcuuaccacucaaggagaugaguauuucaaaucaaauguuaaagggcauugucccggcucaucacaaaagaaugagggagguagugaaggcacgaauugucacagguuuguggcuuggaagauggauuaguuucugaaccucggcacagugggcacauugggcuggauugcuguguggguugccuugugcaccauagcacguggagccguaucccaggccucuacccacuagauagcgcuggggcaccccaccuccccauuugugaccgccacaacugugaucaggcauuccagcuuucccugggaugccugaucaguugagaacccugagccaagcagagaugggucuccuagcuggaagaaagcacaggagaaaagcuguggguuuguuugcuguguguuggggugacaguagggacaagacagggaaggccuuugccuuccuggagccagucaaaagggcaguuuguccagugguaagugccccuacgcccagagugucaggaugucuugacuuuugggggugcguggacuggagguucaucugaggaggugaccugaguuggacccugaaaguccagaagcagccagccauuccgagugcugggaccagcaagugcgaaggucugaguuaggaaagaacuuacagaagaacauagagagccagagccucagagcgugggaagcagagggagagacagacggcaaggacuuggugguauucaggucaugaugggaagccacuggaugguuuucagcaggggaggaauagucuagauagucuaguuugauuuuuuuuuuuugagauggagucugugucgcccagguuggagugcaguggcgcgaucucagcuacugcaagcuccgccucccggguucacgucauucuccugccucagccucccgagaagcugggacuguaggugcccgccaccaugcccggcuaauuuuuuuuuuuuuuuuuuuuuuguauuuuuaguagagaugggguuucaccgugcuagccaggauggucuugaccuccugaccucaugaucugcccgucucggccucccaaagugugugaagggaacaaggagauauauucugggugaagggugaugcuggcugcagauggugagcccucagacucacuaguggacauggaagaugaggaaaggggccccagcauggucagugggaagggcuggggaccuucagguugggcccacagggguaggagacauuaccguggggccacggggguagcuggaacagggaggucagcgcuguggagacuacagccguguggaggggcguucgcauggagauccccaaagcugcagaugaucacacgugaacaccaaggccccagcuggggcaagagcuggaauaccccccugcagcucugcugcuuccuccacagaugacaccuuugaggcccugugcaucgagccguuuuccagcccgccagagcugcccgaugugaugaagccccaggacucgggaagcagugccaaugaacaagccgugcagugaggacccccaagaggcccauuucccccaauaaaagagauuugggagucugccugguugcugccucuuuuucccgccccucccugggaugggucccacucccugugggcuccuuuuggggcuugugcuuggcaguuccugugcuguccugucucccagauccugagacccuggcugagaacuuggcccagccugcugcuuaaaggcaccauggggaccuggguugcccugagacccaagccauuguuagcagcuagccagccacaccaaccacgccagggggaggaaagggaaggacugggagagacacaaagaccagagccagccucagggacaagagauuccaguuuuaggccuuucuccuucuaagugccccccacccccauagccugcauguccacucccagacgauggccaagagcagaaacacaagcuggagccaguguccugguuugacagcauguucaacgagggaaccccaagacggacccacacagguccacccacgcugggggcuguaaucacggagggaaguggcugcccccuuaacacaccuuuaauaaacagucuacagaccca

SEQ ID NO: 193046 - RNA, 17866 nt, Homo sapiens
gucugugcaaaugcuuuaaugguggauucuuagauacagugguuaauccauugcccacaauucuuuacuaauuccgaggcaccucaugccgggaacacacuuucccuuccacuaaacaaaggugaccgcguuucagagcucuccucuuacaagguucacguccuucguuaggccgaggaccgugguacuacaaaagaacauuucguuagcugaagucacuacgauuggcgagaaacauccguuacuucagaauacguuaacuacaaaauauauugaauuuccauauguauuaaccauauacauguguaacuauuacuaaauguaguucagucauuacaaaauaagacauucugggagcgggcuacaaauauucaaaccagcugaauuccccagguaaggccccguguuauaaacaaaccacaaacaucagacgucagaccgagagcucagugacugcagggugcguagccggaaaagccaacaaggcacuggcaccgcagagucgcuggaggggugguggggggcacugccggcucggggggccuuuggaagucaccucuaacuucgauucccagccaacagcggcuggagucccacacggaccuggagggugccgagcuccccuucccagggcccuggaccgcccucccugcauucuuugcuccuuuggggagccccgcccugcccucuugggacccugcacuugggccacggggacccagcuccagccaccggggggugccagggcagcagggccagcuccagccccaaggcuugaaacgaaacugaggagggccaagcucgcuaggauggggagacuggguugggagccagagguuggagggcugggagcaccgggcugugucccccagggcuucccaucucuguccacugugccuuccugcugggaggugaccggcacccaacuucccagccaggccacuuccugcaguggcucaggcagccccaagaggccuggccggcccaaccuuugcagagggcucagcgucaggacggcugcugaggcgcacagccuccccaggacagaccacacucagguggccucaggacgaagaauuccagacacaggcugcccagggcccucuaccuggcgcuaagggucggggaagcccuggagggccacggcugugggcucucccagaaaaagcaccuggcguuugccacgggugguagcaaggcugccuccugaggacacaagggacagacaccugagguggcacccuaugcacagcgcagcuccaucccugugaccuggccacugaagaggggaacccccgccagcaggcugcccggauaggaguccucaggcagcccccagcccuggucuggaccuggccuuguggcccccaagacagcuggcaccggugcaguugccagggucucgaugccaaucccgaccuaugcagaucuuagcugcccagcgcucuacagcccgcagaugcggggagcacagaaaccucagcagcacuuuguacacagcccuguuuacaaagauccagggcaagacagagccucacagccugcgugcauccgaagcagauggagagccugguccuggcccgcgguggggcugcagguggguggggagggccgggcacugggaggccgccuccucucacuuucaaugauaauaaugcaaccaaaaccuuuauauaaacaguuuauuuacucuaaacagcaacacagacaaaacgccauauaaacacaaaggaaguggcgcagaaccgagaugcugaccuggggucugaggcucaaaagcagcacagcccagguucuagaagguucuagagaggagcggcaggagggagggugcauuuccauacagccagcugaggccaagugcagcucugcacggugagaagcaugccugcaucccagagcgaggaacucgccccugggggacuuacccaaguauaaaaguuuauaauuuuacagcaguugaaauacugacaucaauauuaaaauaaaagcgaguuuuacauaacaaucaaaaauacaaaagaccgaaggaagagacccuguauggaaacgggcaauucagcgaaucgagaccgcacacccgcggcggcaauggaagauggcgcccgcccaacccccccaggugacuagucauuguauggagcaacuuuagauuugcaaaaauguuguaaacaaguucuugccaaaccaaucccuuccuuuugacgaugccacaaggucgcugcuuaugagggcgcaaacuucuuggcuugugcucggacccuuuucucguacuccacucuguuuuggcugaggaggucaaaagagaagagacguguuagagggcugagcugccuggcccucacgcucgccccggagccagcugggcagaccaggcugcaggaugggaccuccugggggagggcaguguggagcucgucauaguaacagaagcagaagcccggagaagcagggaggccugcgugguggggagcccaugcuggcucugacguggcugagacugucccguggucugacgggggcagaagggcagggaggagaggaacccacgcugggugaacgugguguucaagggggacagaggggucccgcagggcugcgaggagggcucaggcccagagggcccacgccagggccugcaacaucguugccgaugccaagucugguccuaacuaguaaucagcagcuucucuuuucuguaggucuggggacaguccuaauaaacugaaaacacugacugcuugccacuguuuuuguuaauucccaaaaauagacaccaauuucuggaggguuuuuccaugaggcucucagccgcaggggcaaaggugugggaaggcaggccugguugagaaggcguugugcccgagcugggcagugcaggggcaucagcgaacaggucuggagcuggguagagugaggcucagccugcaagcagcugcccaggagaguggcauggcacacacugcccgggcaaaacaggugggcgggagggcggccgaggcugcaccuaggggcugaugggucacagggugcagugugacccugaggaugggggaacaccaugacauuuauggagguggcuccuggggucgcaguccugccagucucgccaggauuggaccuggucugagacacugagccucacucugcaugguggaacagcccaggacggcagcagcgccggugccacccccacccacgccaagggccuggaccgcagcccagaccccagcgcccuccuugggccaccagccggccccagggcagagcagcucagcugggugggcguggaaggaaccagaggcgguggcuacacgucccagcucuuccuugaccaagcagaggccccgagaaaaggcaccugccagggcaggaacacgguccaaggccuccaggaaacccaggaaaaacgaucugaaacccgcacacaugcuucacaaagggugcuuuucaagcggauguguguaggagaaagaacguuuguuuacgugcacgcaaguguacagugcagcccagcaggcaccaagcccaggagacgcuggggagagucacacggggcgggggacugcaacccugcccagcccacgccgcagaugggagccacagcccagcucuggagauggucggcaaauggggugcaggccagacagagcucacgcccacaccaugcuggggauggcagaccaucuaagggcuaggcaggaaaacauuugccuuuuguuuuguuuuuuugagacagagucuggcucuguugcccaggcuggagugcaguggcgugaucucggcucacuguaagcuccgccucccagguucaagccauucuccugccucagccucccgaguagcugggguuacaggugugcgccaccacgcccggcuaauuuuuuuuauuuuuacuagagaugggguuucaccguguuagccaggauggucucaaucuccugaccucgugaucugcccaccuuggccucccaaagugcugggauuacaggcgugagccaccgcgcccggcaugcuuuuuuuuuuuuuuuugagacagggucucacuuugucacccaggcugcaaucuuggcucacugcagcaucaaccaccugggcucaagcaguccucccaccucagccucccaaauagcugggacuacaggcaugcaccaucauccccggcuuaauuuuuuuuuuuuuuuuuuuuuuaaagagagcaggucuugccauguggcccaggcuggucuccaacuccugggcucagguaacgucccacaguggccuugcaaagugcugggauuacaggcaugagccaccaccccuggcaaauuuuuuaauuuuuuguagagauagggucucgcuauguugcccagucuagucaugaacuccugaguucaagcaaucagcccaccuuggccucccaaaguguugagauuacagguguugggccaccacacuuggccuagaaaucauuuuccaggcacgguggcucaugccuauaaucccggcacuuugggaggcgaggcggguggaucaccugaggucagaaguucgagaccagccuggccaacguggugaaacacugucuuuacuaaaaauacaaaaauuagucaggugugguggugggugccuguaaucccagcuacuugggaggcugaggcaggagaaucacuugaacccaggaggcagagguuguagugagcugagaucacaccacugcacuccagccugggcgacagagugagacucuguuuaaaaaaaaaaaaaaaaaaaaaaaagaaaacauuuucugccucaagggccauguggacacccacgagcacuguggcuuccuguccaagggaaugcauuucacggacuccuagggcacagcaggccagcacacaaacccaggucacgccacgucccacgagccacuuccagcaauggcuuggcugacugagcggcuaugaguuuuuuuuuuuuuuugagacagggucucgcuuugucaagcaggcuggauugcggugcugcaaucucaacucacugcgcaucaaccuccugggcucaagcaguccucccaccucagccucccaaauagcugggacuacaggugugcaccaccaugcaggggagccaggcugagccugggguggcugcugugauacuugcucccugccuggggccucugugccacccucggccaccagggagggcaccuugcagacaccugggcugggcccgcauccagggagaaacacaucucuccaaaaccacgugcuuuuuuuuuuuuugagacagcauuccuccgucgccaggcuggagagcaguggcaggaucucggcucacugcaacuuccgccucccggguucaagugauucuccugucucagccucccagguagcugggauuagaggcacccaccacuacgcccaacuaauuuuuuguauuuuuaguagggacgaggguuucgccauguuggccaggcuggucucgaacuccugaccgcaugauucacccaccucggccucccaaagugcugggauuacaagcgugagccacugcgcccggccgaaaccaggugcuuuuccucacgaccugugcaggccgggccuaaggcaaccgggaccccucagccuccccccuccugaccaggagaugcacccuggagggagagggccucugaugcccacaguggcagggaugugugggguggcugcaggugagccuucugggucccuggccauugggggcccugagacccccucagagguguggggacccguggugagauggggcuggguuucucaacgcugcaggcggagcaguggggggucggaggccccaacccaccuucuuauggaccugcccagaacagcugcagagggaacaggacaggcgggcgcauggccucugcucagggcaggguccucccugcuuuccccagcacuguuuggcugucgucugcauccuaacucacaccaggcccuccucggugcagacaggaccccaggcccacggggacccuucuagccacagcagcaccucacagggacaggguggaagcccaggguccgugugacagcaucacgucacugagcccugcugggcugggcccccccacagaaggaaccaaguuguagaggggauggggacaagcagcaagggcggcgcgggaggcugggguccaugggaggcugagccgguggagaggccucucagcauggccuccucuggcacccacgcccaggguccuuccccuccuagcuggccacaacucacuggggcaguggcccaagacagcccgucaccuggccugcucccuccccgggacacggcuccggcgccauccaugcccaccgcagacggugugcaacggugccugcugcccacaggguuuaugccccccgaccuuccccacagaggcguggacccuggcuguccguagggugagccuguguccuccacucccguccugccaggcggccuuggcugggacggggaggagcugccaccagcggggccagggcugcuacuaaccaguaaaucguguaggccucugcuugagcugggucuuggauauuugguucauuuagaaguuccuguauuccuaauaggaucugugccagagacaaaaacacaagacgggugugagcaguuugaaagggagacaccgugagacucggccucagccacagagaaugaccacagacccacguguccggaggggagacuaaggcagcccugccggugccagaggcggaggccccguaccuguuugauugugauggcuggccuccaguccuuguccuccucuaagauggacaggcacacuguccccgaaggguacacauucgggugaaauaauggugguucgaauuuaccuggaggaagaggaagaaaggaagcacuuuuuggaggcaggcacugucccagagucacguccuuccccacaucacccuccucccaacacuggggccccggguugguagccagguuauuuggccaaaaacuuuucaaaaaaauuaaauuguggccaugaggagacuaaaggaagacauauccaccuuugcacacagggaacagagccuuggggacacggccgcagccgagacgaagcugugucucucccaggacagaacucccagcacagccaggcagucugggaacacaggccccaggguggccacuuaaccuguggcccccacauccuuuccagcugggccagacucaggggagaugggaggagcugcaggagacguccagggacauagccaacgcccuuccagagucggcuguuccgacgcagacccucugcuuccaggauauacgggcuuuuaggacccuguguuauuucuuuacaaaaaagcagaaaaguuugccaccauuagccccaccagggaccaucacaguugauauucuaggcuauuucccaucuuuuaccugggcauccucccucuucucucucaaugcuacggaaggacacacagugcggcaugucuagugcagccggaggaauuaccagaaagccaacgcgccacgaacaccuacagcuuccccgaacacucgcuccuaccgaccacugcaucugccccguaaucccaacugcaacauccgcaggcagcuuccuggacuucagguaccauggagaugcacagggcacacucccuggggaacgcgaagacaccaccgcagaccgucccacaccgcgaccaucccacaccgcaggagcacacgggcgacaccagcagcugcguggcuguccugagugcgaacacgcgugagcgcgcugcuguggaauguggggugacgguguuggcccucaagccgugcugcuuccaggcugcucacgcaggcugcgucgcuggcggauuccagccaccgggugaggugcacggcagccacuccguggugcuacgcugcgccugcuggugaccgcugagcgccccuuucggcccaggcugcuuccuggcgacugcuucgcagaaguuccucaagcgauacgucuuacagggcucuucugcuuggggcuugacuuuuugcuuuuuuaauuuuuugagauggaguuucacuguggugcccaggcuggaucucggcucacugcagccuucaccucccgggcucaagugauucucccgccucaccuuggccuccagaguagcugagguuacaggcacccgccaucaagcuuggccaauuuuucuauuuuauuagaaccgggguuccuccacuguuggucaggcuggucucaaacuccugaccuuaagugauucacuugccuuggccucccaaagugcugggaucacaggugugagccaacgcgcccggcccgaccuuuuccucuucuaagggaaucuuuuggcaaaaacaaaaauugccuaauuucaauuuaaucugauucucaaucucguuucuucugccgaucacaacuuacccgcagaaaggcacagaugcuggaugccagcacugccagguccaccugucccucccaagguagaggcugccuccuacuuccucauggccuccggcuuggccgcucccgcgcuucaaagaaggaacacaaagggggugcccuccugucuggacuguccgccaggcaucauguggccucuucacucuucccuaccugucauccuaggacgucugggcuggggcaagugggggugacaccggcacccaucugugccucugguggacacauguaugugcuucugugaaucucgacugacucaagugaacagccagguccuacagcaugagcucagcuuccacugguguggcaggcagcguccaggggaaacguucagaacauccgcucucuccagcgguggcugaggcucccgcugcccugcgccgcggcuccgucugcuccccugugcgcuacggcagaucccacuggggaggcuuucacucuuuggcaaagccaggcaucccugccgcauuugcuggcuggguggaggccuuuccugugagggacacgcuggacgucauggcagccuucuuacugauucccaggagcucuugguagauucagggugagggcugagguacguacauacacuguagugugcccuccugcccggcgccaacugcagucuuuaugauaaagagagauucuuaauuucaacuuagucaacucgucaaucucccuccggccagcacuucacugcaucccuggugaagagaucccugccugcccagggcucacggacaccaucccgggucuuccucuccacgcuguccugcuugggcaccacaagccaucuggaagcuguuucucuauggugggaggcagagcucgucucuccugcuggaauaucccucaggugucacagcccaaaccaccacaugcguggccuccggacuccucguucuguccgcgggucugccugccugucuucucagcaagccugcagucuccaucaccgugucccguggcaggucuaguggggggugggugggugugcucugcacccacggagccucagccugggucucgccaccccaccaagaagccaaggccuccacguuucugcauuuccuggguccaugggacaguuuccaacaagaugugcuugacuccaacugggaucacauggaaucugcagacgagccuggagagaagggcugucuguacaaugucguguguuccccuccacacacacggcagagcucagcuaccgcucaggccggccuugguuucccuugcaauauucuacaguuuucgguacagagguccugaaccaaucuuuuauugcauuuauuccaacguauuucaugcuacuauaaauggcaguuuuaaaaccuugcucgcugaaaugauauaaaagcagauuuguguaccucaaucucgacuucauuuuuauauuuauuauuuagcuuuguuuccuuuaccagguccugugcuacuuuucuuuucuuuuuuuuuuuuugagacagggucuugcccugcugcccaggcuggaguguaguggcgcgaucucggcucacuggacccgccuccuggauucaagcacuucuccugccucagccucccgagcagcugggauuaaaggcacccaccaccacacccgcuaauuuuuguuuguuuguuuguuuuuuuuaguagagacaggguuucaccauguuguccaggcuggucuucaccucaggugauccucccaccucggccuccaaaagugcugggauuccaggugugagccaccgugcccagccuugcaccucagcuuuacugagcuguuguccuggccuuccuccccaccucuuccguugugacuucuuuuucuugucuugcugcauuugcuuggaauuccaaucaacgguugaacagaaucaaugaaagcagcuacugugucucauucuuauauuuuucuuaauuaaaauaagucaucuuaaguaauaccugcucaugguuuaaaaaaaaaaucaaacagcaaaggacaauccaaaaaugaagcaagucucgaccagcuggugcugucagcaguccucaagcuccucuggucacugccacuguggaaaacacuugugugucuugagugacaauugcaguggaagcuuuuacacagcacucucgccucaccguggccaggcgcugucuaggugcugggcacguguuaaugcguggaacucaccacagaaagggccugccgauuuccagcuaugggacggcagggacguggcggcccucuccucccucuccugaguuuugcugaacugacugagaucacuaacuuagcuguaggcucaaagucgaaccuggccucagcccuuucuucucgcgccuucucugcugcuccccugcucuaugccugcccggcugcagacgcagccccgggugggagagacugcgagagcccacaggaagagcagugagguggggcaagauaaacccuccagugagacucggagugguggcgcuucugcacguccaucccauccagggcuggggucuugugggcaccaaauccugucuucaucgccaacaaucacugaggguccaggcacuccuagcccaggagcuccagccuggaucucacagccucucccugcaaaggacucuggagcuucccagccaauuagcugggaugagagacuaagucuauuacgugcaccgcccacccguggagcuggaaacagacucgcaucugcagccugaggcggggaucagggaucaaagccgaccuccaaaucugugaucucacucccucccagcuccauggaucgcccggaccagggcgccacggccacagccacgggccucuuuggagaggacuccaauccccgcaggaacaggccgacuuccaggacacugaacagggagcuacuuacauuuugguggcgaagauggauaaucaucuuugaaaagcauccguaguuuaaacaagccuccuucccacggagucuguggggaaauaaaccguggugagaugggcugcuugccugccgcaggccggcccaggaggaaggggaucgcuucuaggacacaaccuccaggacugcgaggacaccgggggccagaggcccgacagaggcggcucccauaccagccugaagccuggaccagccccaccaagggggcggucaggaccucugccaugcccagagagugagucggaaaggcccuccuggaaaggagaggaggagacgggggucgggggcugggcuggggggcaacgagugccgcacacuggggccggcagcgccaagagcacacccgugcccucaccccaggguguucugcaagccccugccccaggucccgccuggaugaggcgccuuugccaccccacaacccgacaccacucccgucuuccuuggggccgcgcgcgcaccugccucgccguaaugugaagggcaagggacguucucagcagagccucagacaagugacaaauccaagccacauccugucucgggcaaagcugaguccugcugggacugcucagcucagggggccggagcugcugugaguuucagagcgaaacccagaggcuggcaugggccggagggaacaaggccucgggcaggaccaacaccucagggaucucuccuuccuucagaguccacgagcaugaaccuuaugugcaagccggccuggagucccuggccaagcacuucaugugagccgggcaaagaggacaggcacaugggccgcccugcuugccacagacacacggggccccaagcaggcauccuagguggcugccgccagucccugugccccaggagguucuccaguagacgguuuuaggccgggguggcucuccugcaaacccagcucccgcgaccugagccacaccuggaaggacacagcagaaucccggguuccagcacgcaaaggcugcccgccccucaggccugcucccaacacacaucagagccccuuccccucugccacagcucagcccugugcccggccaggcccagccugcuuccuucucaaccagaaaugcccucgguagggacacagcugucaccccaaccuugccagcaccaccuucugagcucaaguccucacggggcgggggccaggccacagcuggggaucugagcuguugaccgcggccugugacaaggguggccgucacggacggcagggaucugagcggaguauccccauggcacugccgcacgcaucugcugagccccgacaggcaggaggccggcagcgccccuuaccccuuucuuuccuggaauggcgcacucccaguucaugagguucaucgugccaucgggauuuuuuguugggacagccacgaaacccugagagaaaagaaaacaaccacaaaagcauaucagcguggcggcaucuaguuugagcaaaaccaccaagaaccggccugcgagucccaccggcccagcccaggcacgcgaccagcucccucccaguagggagggcgcgguuucagccgagggagccuguccgcggcacugcacacagaaaugaagcccuccuuacaaauggguggucuuuccuccaugcuuuccucuccugggcgagucugcugagggcgauccccgacauguucaaagucccuggaacacaggaggcagagcacggggucaggagaggcgagcgggcuccugccaccccagcacgcgcacguggcccgcagcaggcaggcuugcuccuaacauacgguggccuggcccagcagggacucucuucuugcaagccgucguccgaccccgggggucuaccaggggaggccuugugagcggcgcccagaucaccgggaggcgggggcagguaggaccccuccccauggccccaacccagcccuggucugcgacacaugcugcggccucugcucgaaggugaggagacagauguucagaggcugggccgcugcggcugggggguagcugccacccugugguggcugacauggcaggguccucaccauaccaucagguggggacuaggcagggcuggggccccagauggauguggggugcugggucccugccuuaguaucaggcgcucagaacugagacucaggcugggccaggggacaccuguuauucuuuuuuuuuuuuuuuuuuuuuuuuuuugagacagagucucauucuauugcucaggcuggaaugcaguggcacgaucucggcucacugcaaccuccgccuccugaguucaagcaauucuccugccucagccucccgaguagcugagacuacaggcgugugccaccacgcccagcuaauuuuuguauuuuuaguagagauaggguuucaccauguugaagacagagcagaacaaguaccacagggcagaggcucagccucacugagagaggagcccuccacggggacacccuucccagaccgugcagccacuaccacgucccuguggcuucaggggacagacggguccugcagggcagggcaggagcaugggguaggggaccaggucccugaucagaggcagcggcacacacgccagauuccagcuccacacaucugcacgggaccucgggggcuuggcaccuucgccuuugcguucucggcgggagccugucggccagcacugucacuggggacaccaggcagacagggccagcagccucaaugccacccucaacugucacccuacugguggccaccuuuacccacgaaaaacagcgcucaagauacaaaacuugcccaagaauucaaaccuaagugugugcugguuuucaaaguccaugggaacacugaagcuacuacccccaagucugauaucucaacaccaaacaagagccaccucuacaaagcugggggacugagccaggucuucuaagcuguggggggccgucccuacuacggcuugggcuguccuagaauagccacaagggcccuggggaccuggauggcucccacaccuguggaggcccacgaaccucacacaccucgcagccgcagaaaggggccaggucagcagcuccaccugcgucggagccgccgcagccucaccuggcacucguuagggagacaaggcccaguccccggcagacccacggacgaaggagcucugagaggcccgcacucagguucuggguggcacgaugacuuccccagucagcagagcagaaaucgggggugggguugggaucaaagaagccaaggcagguccagugucgccagggcaccaggcuucugaagcugcuagagccgccugcccugcaggugaauuuggcuccuuuucaccaaacacagauccucagggcagccugagaaaaagcaggcgaaggaaccuggguccuccagucagcaggcgcuggcgucacagcgagagggugacaggggccagccgggcacuggccuccagguccacgacuaaguccaagacaggcagcccgggcuggaggcagccccagaccgggccccaccgggauguccuuccccacgcccuccucacaugaugcagaggagcccgcaggccgcccgcccucuggaccguuugcccuuccccgugcccuccucuaagugagggggggggagccaggggccagacagggagaaaguggggggcacagcuauggucaggcaggguucgagcccagagcggaguggagcgcccgccaaccacgguuucaaggcugucuccgcacugggcuggacuccgaaacuccacacguuccuccacccuccacucccacguggagcagcccagcugcgacuugaggacucacagcucucgcuuccccagccccaggaugggcuuccugaguggccgcagccugugcccggugcggugcaaagcagccuggcgaguggccauuucaaggaggcacgaccucccaggugcccggggucugagcgaggccaggcaucaggcaagucucugaagccucaggccagugcuccagacacugaaggaccaugggcaaggcuauccucacagccaggcaaggccaggccacagagaggccagacgggccugggacccugccacaggcagcccuccugcugaggacuggacagagccgccuagaggcccccgucccagcaccuagcuauugcugucucaggugugagaagucgugaggggugguccugcgagaccuccugccaagaccuggcugcugcugcuguguccccugccccaaagcacucagcaccacgggguggucucacaggcacugcaccgccagggcaaggagccacaggugcacacccaccgugucccagacagaagccaggccccucccccugcacccccuccuacuggccuucuggagaaagcggccaaucuguuacaauguaaucacaacacagaucaagcguucaaaauuccgcugaaaaucgaauuugcccuuccaaauucacagauaggcacuuagugaacggcuaguaguuacuaaacgcuucagagcaagaaacuuuuaugaugcaaagacaaaaacaacccucaucuauuagagccaggcaaggcccagacacugcagaaacggggacagggccgggcacuccaggagcggcccgaaagucugccuucuguccuccugcugggcgcccgcaaccggcugagcuuuagcuucucggaucaccgccuugcucugcugguugacagcaccgacuucagagcaacuuccuggcugagggugagcaaagcacucaccucccacaacuccaccgcacugaucuccacaacggguggucgccacgacaggcuggcacaagaagccuuuaaaggcccuccugcacccaaaugcaaacucucccaggcuuggggagguauucccuucugcaagacccaagcaccugcagucgggagacgcuuaccuggccgcaccugaucugccccaggccccgagaauguuucugaagcaagaucccaaacccugagacaccauacaagcgcacaccagcaaucacccaguggccuagggaacggaccucucugaaugagcaaucagggcaaacugaggauccgucccgucuuccguugcauagguucucuacccaaaggcaacguuucuugaagagcaagaaacacuugggguagguccuguaaaaggaaacaaaccgaacuccccaaagacaggcacuuugcaaacagagaaacuaagcguaacuuccaauuauacaaacaaaaccacuucauucugcgauucaagcgugacuacaggccacgaucacaagcccaacuaaucauucccuuacauuccuccuacgcacguuaacuaccagaaccaacuacuauucaaccgauaaaaagagauguccaaaacagaauaaaacucccccuccagcgaggcgcucacguucagggccccagcaagcgccagcggagcaucuucagaggcacaagaaaacuuacacuuguuuugguuuuaaggcaccgaaaacaagcccgcucgccggcccccacccccgcgagccagcgauguugcaauccaagacucuccccccgcggcccauccuauccguccgcggggcgaccgugaccccggaagccgcuccccgcgcaggaggaaggcgcggccucgcggggccccggcugcagguggcugccccggccccgcgccaggcgcaccucgggggcgaagugggggagccccggccccgaaggccugcggcggcccggccgcucgggccgcagcccagcggcgccagcagcgcggaccgagccggcgccgagcgcggggccucucgggcuccccggaaagcucggccgcggcgcggggcccggcucggcggggcggggcgcggggcagucgggggcccgggcccaacaggaguagaggccucggcccgacccccgccccgcggccccggcccggcccccgcacgcgcucaccucgggcggccgcagccccggcgagcguagcggacagguggaggaccgagcggggcggcggcggcggcgcuucccuuugucucgggacuucccuccggagcccgcuccgcgcgcagccagagcagcuccgaggacccuggcgcgggcggggcgcgcggggcggggccuaacgcggggcugcccucugcacgccugccucgcgcgccgcuccugccgcccggccccgagcgccucccgcgccgccgagcgcuccccguugcccgcgccccgccgccgcgcgcccgcgccccggguccgccccaggagcccggccggggggcgacuuuccagucaggcggcgcccuggacaccuacgcccuuaaaggagccgcguccccgaugugagggagcgucuguaaacuccccuucgggcugcccgcguccacccgaggacacgccggcaagcagcgggggaaaaaggaagccgagaucuccaaaggcuccccggaugccuggcggucaccucuccagccacaggucccggagguuuccuuggggucagguccuggggccgggggucaaagaccacugaggccuaaggauccucugaagcgucgcaggacggugacgcucccgcgaguu

SEQ ID NO: 193047 - RNA, 17866 nt, Homo sapiens
aacucgcgggagcgucaccguccugcgacgcuucagaggauccuuaggccucaguggucuuugacccccggccccaggaccugaccccaaggaaaccuccgggaccuguggcuggagaggugaccgccaggcauccggggagccuuuggagaucucggcuuccuuuuucccccgcugcuugccggcguguccucggguggacgcgggcagcccgaaggggaguuuacagacgcucccucacaucggggacgcggcuccuuuaagggcguagguguccagggcgccgccugacuggaaagucgccccccggccgggcuccuggggcggacccggggcgcgggcgcgcggcggcggggcgcgggcaacggggagcgcucggcggcgcgggaggcgcucggggccgggcggcaggagcggcgcgcgaggcaggcgugcagagggcagccccgcguuaggccccgccccgcgcgccccgcccgcgccaggguccucggagcugcucuggcugcgcgcggagcgggcuccggagggaagucccgagacaaagggaagcgccgccgccgccgccccgcucgguccuccaccuguccgcuacgcucgccggggcugcggccgcccgaggugagcgcgugcgggggccgggccggggccgcggggcgggggucgggccgaggccucuacuccuguugggcccgggcccccgacugccccgcgccccgccccgccgagccgggccccgcgccgcggccgagcuuuccggggagcccgagaggccccgcgcucggcgccggcucgguccgcgcugcuggcgccgcugggcugcggcccgagcggccgggccgccgcaggccuucggggccggggcucccccacuucgcccccgaggugcgccuggcgcggggccggggcagccaccugcagccggggccccgcgaggccgcgccuuccuccugcgcggggagcggcuuccggggucacggucgccccgcggacggauaggaugggccgcggggggagagucuuggauugcaacaucgcuggcucgcgggggugggggccggcgagcgggcuuguuuucggugccuuaaaaccaaaacaaguguaaguuuucuugugccucugaagaugcuccgcuggcgcuugcuggggcccugaacgugagcgccucgcuggagggggaguuuuauucuguuuuggacaucucuuuuuaucgguugaauaguaguugguucugguaguuaacgugcguaggaggaauguaagggaaugauuaguugggcuugugaucguggccuguagucacgcuugaaucgcagaaugaagugguuuuguuuguauaauuggaaguuacgcuuaguuucucuguuugcaaagugccugucuuuggggaguucgguuuguuuccuuuuacaggaccuaccccaaguguuucuugcucuucaagaaacguugccuuuggguagagaaccuaugcaacggaagacgggacggauccucaguuugcccugauugcucauucagagagguccguucccuaggccacugggugauugcuggugugcgcuuguauggugucucaggguuugggaucuugcuucagaaacauucucggggccuggggcagaucaggugcggccagguaagcgucucccgacugcaggugcuugggucuugcagaagggaauaccuccccaagccugggagaguuugcauuugggugcaggagggccuuuaaaggcuucuugugccagccugucguggcgaccacccguuguggagaucagugcgguggaguugugggaggugagugcuuugcucacccucagccaggaaguugcucugaagucggugcugucaaccagcagagcaaggcggugauccgagaagcuaaagcucagccgguugcgggcgcccagcaggaggacagaaggcagacuuucgggccgcuccuggagugcccggcccuguccccguuucugcagugucugggccuugccuggcucuaauagaugaggguuguuuuugucuuugcaucauaaaaguuucuugcucugaagcguuuaguaacuacuagccguucacuaagugccuaucugugaauuuggaagggcaaauucgauuuucagcggaauuuugaacgcuugaucuguguugugauuacauuguaacagauuggccgcuuucuccagaaggccaguaggagggggugcagggggaggggccuggcuucugucugggacacggugggugugcaccuguggcuccuugcccuggcggugcagugccugugagaccaccccguggugcugagugcuuuggggcaggggacacagcagcagcagccaggucuuggcaggaggucucgcaggaccaccccucacgacuucucacaccugagacagcaauagcuaggugcugggacgggggccucuaggcggcucuguccaguccucagcaggagggcugccuguggcagggucccaggcccgucuggccucucuguggccuggccuugccuggcugugaggauagccuugcccaugguccuucagugucuggagcacuggccugaggcuucagagacuugccugaugccuggccucgcucagaccccgggcaccugggaggucgugccuccuugaaauggccacucgccaggcugcuuugcaccgcaccgggcacaggcugcggccacucaggaagcccauccuggggcuggggaagcgagagcugugaguccucaagucgcagcugggcugcuccacgugggaguggaggguggaggaacguguggaguuucggaguccagcccagugcggagacagccuugaaaccgugguuggcgggcgcuccacuccgcucugggcucgaacccugccugaccauagcugugccccccacuuucucccugucuggccccuggcucccccccccucacuuagaggagggcacggggaagggcaaacgguccagagggcgggcggccugcgggcuccucugcaucaugugaggagggcguggggaaggacaucccgguggggcccggucuggggcugccuccagcccgggcugccugucuuggacuuagucguggaccuggaggccagugcccggcuggccccugucacccucucgcugugacgccagcgccugcugacuggaggacccagguuccuucgccugcuuuuucucaggcugcccugaggaucuguguuuggugaaaaggagccaaauucaccugcagggcaggcggcucuagcagcuucagaagccuggugcccuggcgacacuggaccugccuuggcuucuuugaucccaaccccacccccgauuucugcucugcugacuggggaagucaucgugccacccagaaccugagugcgggccucucagagcuccuucguccgugggucugccggggacugggccuugucucccuaacgagugccaggugaggcugcggcggcuccgacgcagguggagcugcugaccuggccccuuucugcggcugcgaggugugugagguucgugggccuccacaggugugggagccauccagguccccagggcccuuguggcuauucuaggacagcccaagccguaguagggacggccccccacagcuuagaagaccuggcucagucccccagcuuuguagagguggcucuuguuugguguugagauaucagacuuggggguaguagcuucaguguucccauggacuuugaaaaccagcacacacuuagguuugaauucuugggcaaguuuuguaucuugagcgcuguuuuucguggguaaagguggccaccaguagggugacaguugaggguggcauugaggcugcuggcccugucugccugguguccccagugacagugcuggccgacaggcucccgccgagaacgcaaaggcgaaggugccaagcccccgaggucccgugcagauguguggagcuggaaucuggcgugugugccgcugccucugaucagggaccugguccccuaccccaugcuccugcccugcccugcaggacccgucuguccccugaagccacagggacgugguaguggcugcacggucugggaaggguguccccguggagggcuccucucucagugaggcugagccucugcccugugguacuuguucugcucugucuucaacauggugaaacccuaucucuacuaaaaauacaaaaauuagcugggcgugguggcacacgccuguagucucagcuacucgggaggcugaggcaggagaauugcuugaacucaggaggcggagguugcagugagccgagaucgugccacugcauuccagccugagcaauagaaugagacucugucucaaaaaaaaaaaaaaaaaaaaaaaaaaagaauaacagguguccccuggcccagccugagucucaguucugagcgccugauacuaaggcagggacccagcaccccacauccaucuggggccccagcccugccuaguccccaccugaugguauggugaggacccugccaugucagccaccacaggguggcagcuaccccccagccgcagcggcccagccucugaacaucugucuccucaccuucgagcagaggccgcagcaugugucgcagaccagggcuggguuggggccauggggagggguccuaccugcccccgccucccggugaucugggcgccgcucacaaggccuccccugguagacccccggggucggacgacggcuugcaagaagagagucccugcugggccaggccaccguauguuaggagcaagccugccugcugcgggccacgugcgcgugcugggguggcaggagcccgcucgccucuccugaccccgugcucugccuccuguguuccagggacuuugaacaugucggggaucgcccucagcagacucgcccaggagaggaaagcauggaggaaagaccacccauuuguaaggagggcuucauuucugugugcagugccgcggacaggcucccucggcugaaaccgcgcccucccuacugggagggagcuggucgcgugccugggcugggccggugggacucgcaggccgguucuuggugguuuugcucaaacuagaugccgccacgcugauaugcuuuugugguuguuuucuuuucucucaggguuucguggcugucccaacaaaaaaucccgauggcacgaugaaccucaugaacugggagugcgccauuccaggaaagaaagggguaaggggcgcugccggccuccugccugucggggcucagcagaugcgugcggcagugccauggggauacuccgcucagaucccugccguccgugacggccacccuugucacaggccgcggucaacagcucagauccccagcuguggccuggcccccgccccgugaggacuugagcucagaagguggugcuggcaagguuggggugacagcugugucccuaccgagggcauuucugguugagaaggaagcaggcugggccuggccgggcacagggcugagcuguggcagaggggaaggggcucugauguguguugggagcaggccugaggggcgggcagccuuugcgugcuggaacccgggauucugcuguguccuuccagguguggcucaggucgcgggagcuggguuugcaggagagccaccccggccuaaaaccgucuacuggagaaccuccuggggcacagggacuggcggcagccaccuaggaugccugcuuggggccccgugugucuguggcaagcagggcggcccaugugccuguccucuuugcccggcucacaugaagugcuuggccagggacuccaggccggcuugcacauaagguucaugcucguggacucugaaggaaggagagaucccugagguguugguccugcccgaggccuuguucccuccggcccaugccagccucuggguuucgcucugaaacucacagcagcuccggcccccugagcugagcagucccagcaggacucagcuuugcccgagacaggauguggcuuggauuugucacuugucugaggcucugcugagaacgucccuugcccuucacauuacggcgaggcaggugcgcgcgcggccccaaggaagacgggaguggugucggguugugggguggcaaaggcgccucauccaggcgggaccuggggcaggggcuugcagaacacccuggggugagggcacgggugugcucuuggcgcugccggccccagugugcggcacucguugccccccagcccagcccccgacccccgucuccuccucuccuuuccaggagggccuuuccgacucacucucugggcauggcagagguccugaccgcccccuugguggggcugguccaggcuucaggcugguaugggagccgccucugucgggccucuggcccccgguguccucgcaguccuggagguuguguccuagaagcgauccccuuccuccugggccggccugcggcaggcaagcagcccaucucaccacgguuuauuuccccacagacuccgugggaaggaggcuuguuuaaacuacggaugcuuuucaaagaugauuauccaucuucgccaccaaaauguaaguagcucccuguucaguguccuggaagucggccuguuccugcggggauuggaguccucuccaaagaggcccguggcuguggccguggcgcccugguccgggcgauccauggagcugggagggagugagaucacagauuuggaggucggcuuugaucccugauccccgccucaggcugcagaugcgagucuguuuccagcuccacgggugggcggugcacguaauagacuuagucucucaucccagcuaauuggcugggaagcuccagaguccuuugcagggagaggcugugagauccaggcuggagcuccugggcuaggagugccuggacccucagugauuguuggcgaugaagacaggauuuggugcccacaagaccccagcccuggaugggauggacgugcagaagcgccaccacuccgagucucacuggaggguuuaucuugccccaccucacugcucuuccugugggcucucgcagucucucccacccggggcugcgucugcagccgggcaggcauagagcaggggagcagcagagaaggcgcgagaagaaagggcugaggccagguucgacuuugagccuacagcuaaguuagugaucucagucaguucagcaaaacucaggagagggaggagagggccgccacgucccugccgucccauagcuggaaaucggcaggcccuuucuguggugaguuccacgcauuaacacgugcccagcaccuagacagcgccuggccacggugaggcgagagugcuguguaaaagcuuccacugcaauugucacucaagacacacaaguguuuuccacaguggcagugaccagaggagcuugaggacugcugacagcaccagcuggucgagacuugcuucauuuuuggauuguccuuugcuguuugauuuuuuuuuuaaaccaugagcagguauuacuuaagaugacuuauuuuaauuaagaaaaauauaagaaugagacacaguagcugcuuucauugauucuguucaaccguugauuggaauuccaagcaaaugcagcaagacaagaaaaagaagucacaacggaagagguggggaggaaggccaggacaacagcucaguaaagcugaggugcaaggcugggcacgguggcucacaccuggaaucccagcacuuuuggaggccgaggugggaggaucaccugaggugaagaccagccuggacaacauggugaaacccugucucuacuaaaaaaaacaaacaaacaaacaaaaauuagcgggugugguggugggugccuuuaaucccagcugcucgggaggcugaggcaggagaagugcuugaauccaggaggcggguccagugagccgagaucgcgccacuacacuccagccugggcagcagggcaagacccugucucaaaaaaaaaaaaagaaaagaaaaguagcacaggaccugguaaaggaaacaaagcuaaauaauaaauauaaaaaugaagucgagauugagguacacaaaucugcuuuuauaucauuucagcgagcaagguuuuaaaacugccauuuauaguagcaugaaauacguuggaauaaaugcaauaaaagauugguucaggaccucuguaccgaaaacuguagaauauugcaagggaaaccaaggccggccugagcgguagcugagcucugccguguguguggaggggaacacacgacauuguacagacagcccuucucuccaggcucgucugcagauuccaugugaucccaguuggagucaagcacaucuuguuggaaacugucccauggacccaggaaaugcagaaacguggaggccuuggcuucuuggugggguggcgagacccaggcugaggcuccgugggugcagagcacacccacccaccccccacuagaccugccacgggacacggugauggagacugcaggcuugcugagaagacaggcaggcagacccgcggacagaacgaggaguccggaggccacgcauguggugguuugggcugugacaccugagggauauuccagcaggagagacgagcucugccucccaccauagagaaacagcuuccagauggcuuguggugcccaagcaggacagcguggagaggaagacccgggaugguguccgugagcccugggcaggcagggaucucuucaccagggaugcagugaagugcuggccggagggagauugacgaguugacuaaguugaaauuaagaaucucucuuuaucauaaagacugcaguuggcgccgggcaggagggcacacuacaguguauguacguaccucagcccucacccugaaucuaccaagagcuccugggaaucaguaagaaggcugccaugacguccagcgugucccucacaggaaaggccuccacccagccagcaaaugcggcagggaugccuggcuuugccaaagagugaaagccuccccagugggaucugccguagcgcacaggggagcagacggagccgcggcgcagggcagcgggagccucagccaccgcuggagagagcggauguucugaacguuuccccuggacgcugccugccacaccaguggaagcugagcucaugcuguaggaccuggcuguucacuugagucagucgagauucacagaagcacauacauguguccaccagaggcacagaugggugccggugucacccccacuugccccagcccagacguccuaggaugacagguagggaagagugaagaggccacaugaugccuggcggacaguccagacaggagggcacccccuuuguguuccuucuuugaagcgcgggagcggccaagccggaggccaugaggaaguaggaggcagccucuaccuugggagggacagguggaccuggcagugcuggcauccagcaucugugccuuucugcggguaaguugugaucggcagaagaaacgagauugagaaucagauuaaauugaaauuaggcaauuuuuguuuuugccaaaagauucccuuagaagaggaaaaggucgggccgggcgcguuggcucacaccugugaucccagcacuuugggaggccaaggcaagugaaucacuuaaggucaggaguuugagaccagccugaccaacaguggaggaaccccgguucuaauaaaauagaaaaauuggccaagcuugauggcgggugccuguaaccucagcuacucuggaggccaaggugaggcgggagaaucacuugagcccgggaggugaaggcugcagugagccgagauccagccugggcaccacagugaaacuccaucucaaaaaauuaaaaaagcaaaaagucaagccccaagcagaagagcccuguaagacguaucgcuugaggaacuucugcgaagcagucgccaggaagcagccugggccgaaaggggcgcucagcggucaccagcaggcgcagcguagcaccacggaguggcugccgugcaccucacccgguggcuggaauccgccagcgacgcagccugcgugagcagccuggaagcagcacggcuugagggccaacaccgucaccccacauuccacagcagcgcgcucacgcguguucgcacucaggacagccacgcagcugcuggugucgcccgugugcuccugcggugugggauggucgcggugugggacggucugcgguggugucuucgcguuccccagggagugugcccugugcaucuccaugguaccugaaguccaggaagcugccugcggauguugcaguugggauuacggggcagaugcaguggucgguaggagcgaguguucggggaagcuguagguguucguggcgcguuggcuuucugguaauuccuccggcugcacuagacaugccgcacuguguguccuuccguagcauugagagagaagagggaggaugcccagguaaaagaugggaaauagccuagaauaucaacugugauggucccugguggggcuaaugguggcaaacuuuucugcuuuuuuguaaagaaauaacacaggguccuaaaagcccguauauccuggaagcagagggucugcgucggaacagccgacucuggaagggcguuggcuaugucccuggacgucuccugcagcuccucccaucuccccugagucuggcccagcuggaaaggaugugggggccacagguuaaguggccacccuggggccuguguucccagacugccuggcugugcugggaguucuguccugggagagacacagcuucgucucggcugcggccguguccccaaggcucuguucccugugugcaaagguggauaugucuuccuuuagucuccucauggccacaauuuaauuuuuuugaaaaguuuuuggccaaauaaccuggcuaccaacccggggccccaguguugggaggagggugauguggggaaggacgugacucugggacagugccugccuccaaaaagugcuuccuuucuuccucuuccuccagguaaauucgaaccaccauuauuucacccgaauguguacccuucggggacagugugccuguccaucuuagaggaggacaaggacuggaggccagccaucacaaucaaacagguacggggccuccgccucuggcaccggcagggcugccuuagucuccccuccggacacgugggucuguggucauucucuguggcugaggccgagucucacggugucucccuuucaaacugcucacacccgucuuguguuuuugucucuggcacagauccuauuaggaauacaggaacuucuaaaugaaccaaauauccaagacccagcucaagcagaggccuacacgauuuacugguuaguagcagcccuggccccgcugguggcagcuccuccccgucccagccaaggccgccuggcaggacgggaguggaggacacaggcucacccuacggacagccaggguccacgccucuguggggaaggucggggggcauaaacccugugggcagcaggcaccguugcacaccgucugcggugggcauggauggcgccggagccgugucccggggagggagcaggccaggugacgggcugucuugggccacugccccagugaguuguggccagcuaggaggggaaggacccugggcgugggugccagaggaggccaugcugagaggccucuccaccggcucagccucccauggaccccagccucccgcgccgcccuugcugcuuguccccauccccucuacaacuugguuccuucugugggggggcccagcccagcagggcucagugacgugaugcugucacacggacccugggcuuccacccugucccugugaggugcugcuguggcuagaaggguccccgugggccugggguccugucugcaccgaggagggccuggugugaguuaggaugcagacgacagccaaacagugcuggggaaagcagggaggacccugcccugagcagaggccaugcgcccgccuguccuguucccucugcagcuguucugggcagguccauaagaagguggguuggggccuccgaccccccacugcuccgccugcagcguugagaaacccagccccaucucaccacggguccccacaccucugagggggucucagggcccccaauggccagggacccagaaggcucaccugcagccaccccacacaucccugccacugugggcaucagaggcccucucccuccagggugcaucuccuggucaggaggggggaggcugaggggucccgguugccuuaggcccggccugcacaggucgugaggaaaagcaccugguuucggccgggcgcaguggcucacgcuuguaaucccagcacuuugggaggccgaggugggugaaucaugcggucaggaguucgagaccagccuggccaacauggcgaaacccucgucccuacuaaaaauacaaaaaauuaguugggcguaguggugggugccucuaaucccagcuaccugggaggcugagacaggagaaucacuugaacccgggaggcggaaguugcagugagccgagauccugccacugcucuccagccuggcgacggaggaaugcugucucaaaaaaaaaaaaagcacgugguuuuggagagauguguuucucccuggaugcgggcccagcccaggugucugcaaggugcccucccugguggccgaggguggcacagaggccccaggcagggagcaaguaucacagcagccaccccaggcucagccuggcuccccugcaugguggugcacaccuguagucccagcuauuugggaggcugaggugggaggacugcuugagcccaggagguugaugcgcagugaguugagauugcagcaccgcaauccagccugcuugacaaagcgagacccugucucaaaaaaaaaaaaaaacucauagccgcucagucagccaagccauugcuggaaguggcucgugggacguggcgugaccuggguuugugugcuggccugcugugcccuaggaguccgugaaaugcauucccuuggacaggaagccacagugcucguggguguccacauggcccuugaggcagaaaauguuuucuuuuuuuuuuuuuuuuuuuuuuuuaaacagagucucacucugucgcccaggcuggagugcaguggugugaucucagcucacuacaaccucugccuccuggguucaagugauucuccugccucagccucccaaguagcugggauuacaggcacccaccaccacaccugacuaauuuuuguauuuuuaguaaagacaguguuucaccacguuggccaggcuggucucgaacuucugaccucaggugauccacccgccucgccucccaaagugccgggauuauaggcaugagccaccgugccuggaaaaugauuucuaggccaagugugguggcccaacaccuguaaucucaacacuuugggaggccaaggugggcugauugcuugaacucaggaguucaugacuagacugggcaacauagcgagacccuaucucuacaaaaaauuaaaaaauuugccaggggugguggcucaugccuguaaucccagcacuuugcaaggccacugugggacguuaccugagcccaggaguuggagaccagccugggccacauggcaagaccugcucucuuuaaaaaaaaaaaaaaaaaaaaaauuaagccggggaugauggugcaugccuguagucccagcuauuugggaggcugaggugggaggacugcuugagcccaggugguugaugcugcagugagccaagauugcagccugggugacaaagugagacccugucucaaaaaaaaaaaaaaaagcaugccgggcgcgguggcucacgccuguaaucccagcacuuugggaggccaaggugggcagaucacgaggucaggagauugagaccauccuggcuaacacggugaaaccccaucucuaguaaaaauaaaaaaaauuagccgggcgugguggcgcacaccuguaaccccagcuacucgggaggcugaggcaggagaauggcuugaaccugggaggcggagcuuacagugagccgagaucacgccacugcacuccagccugggcaacagagccagacucugucucaaaaaaacaaaacaaaaggcaaauguuuuccugccuagcccuuagauggucugccauccccagcauggugugggcgugagcucugucuggccugcaccccauuugccgaccaucuccagagcugggcuguggcucccaucugcggcgugggcugggcaggguugcagucccccgccccgugugacucuccccagcgucuccugggcuuggugccugcugggcugcacuguacacuugcgugcacguaaacaaacguucuuucuccuacacacauccgcuugaaaagcacccuuugugaagcaugugugcggguuucagaucguuuuuccuggguuuccuggaggccuuggaccguguuccugcccuggcaggugccuuuucucggggccucugcuuggucaaggaagagcugggacguguagccaccgccucugguuccuuccacgcccacccagcugagcugcucugcccuggggccggcugguggcccaaggagggcgcuggggucugggcugcgguccaggcccuuggcguggguggggguggcaccggcgcugcugccguccugggcuguuccaccaugcagagugaggcucagugucucagaccagguccaauccuggcgagacuggcaggacugcgaccccaggagccaccuccauaaaugucaugguguucccccauccucagggucacacugcacccugugacccaucagccccuaggugcagccucggccgcccucccgcccaccuguuuugcccgggcagugugugccaugccacucuccugggcagcugcuugcaggcugagccucacucuacccagcuccagaccuguucgcugaugccccugcacugcccagcucgggcacaacgccuucucaaccaggccugccuucccacaccuuugccccugcggcugagagccucauggaaaaacccuccagaaauuggugucuauuuuugggaauuaacaaaaacaguggcaagcagucaguguuuucaguuuauuaggacuguccccagaccuacagaaaagagaagcugcugauuacuaguuaggaccagacuuggcaucggcaacgauguugcaggcccuggcgugggcccucugggccugagcccuccucgcagcccugcgggaccccucugucccccuugaacaccacguucacccagcguggguuccucuccucccugcccuucugcccccgucagaccacgggacagucucagccacgucagagccagcaugggcuccccaccacgcaggccucccugcuucuccgggcuucugcuucuguuacuaugacgagcuccacacugcccucccccaggaggucccauccugcagccuggucugcccagcuggcuccggggcgagcgugagggccaggcagcucagcccucuaacacgucucuucucuuuugaccuccucagccaaaacagaguggaguacgagaaaaggguccgagcacaagccaagaaguuugcgcccucauaagcagcgaccuuguggcaucgucaaaaggaagggauugguuuggcaagaacuuguuuacaacauuuuugcaaaucuaaaguugcuccauacaaugacuagucaccuggggggguugggcgggcgccaucuuccauugccgccgcgggugugcggucucgauucgcugaauugcccguuuccauacagggucucuuccuucggucuuuuguauuuuugauuguuauguaaaacucgcuuuuauuuuaauauugaugucaguauuucaacugcuguaaaauuauaaacuuuuauacuuggguaagucccccaggggcgaguuccucgcucugggaugcaggcaugcuucucaccgugcagagcugcacuuggccucagcuggcuguauggaaaugcacccucccuccugccgcuccucucuagaaccuucuagaaccugggcugugcugcuuuugagccucagaccccaggucagcaucucgguucugcgccacuuccuuuguguuuauauggcguuuugucuguguugcuguuuagaguaaauaaacuguuuauauaaagguuuugguugcauuauuaucauugaaagugagaggaggcggccucccagugcccggcccuccccacccaccugcagccccaccgcgggccaggaccaggcucuccaucugcuucggaugcacgcaggcugugaggcucugucuugcccuggaucuuuguaaacagggcuguguacaaagugcugcugagguuucugugcuccccgcaucugcgggcuguagagcgcugggcagcuaagaucugcauaggucgggauuggcaucgagacccuggcaacugcaccggugccagcugucuugggggccacaaggccagguccagaccagggcugggggcugccugaggacuccuauccgggcagccugcuggcggggguuccccucuucaguggccaggucacagggauggagcugcgcugugcauagggugccaccucaggugucugucccuuguguccucaggaggcagccuugcuaccacccguggcaaacgccaggugcuuuuucugggagagcccacagccguggcccuccagggcuuccccgacccuuagcgccagguagagggcccugggcagccugugucuggaauucuucguccugaggccaccugaguguggucuguccuggggaggcugugcgccucagcagccguccugacgcugagcccucugcaaagguugggccggccaggccucuuggggcugccugagccacugcaggaaguggccuggcugggaaguugggugccggucaccucccagcaggaaggcacaguggacagagaugggaagcccugggggacacagcccggugcucccagcccuccaaccucuggcucccaacccagucuccccauccuagcgagcuuggcccuccucaguuucguuucaagccuuggggcuggagcuggcccugcugcccuggcaccccccgguggcuggagcuggguccccguggcccaagugcagggucccaagagggcagggcggggcuccccaaaggagcaaagaaugcagggagggcgguccagggcccugggaaggggagcucggcacccuccagguccgugugggacuccagccgcuguuggcugggaaucgaaguuagaggugacuuccaaaggccccccgagccggcagugccccccaccaccccuccagcgacucugcggugccagugccuuguuggcuuuuccggcuacgcacccugcagucacugagcucucggucugacgucugauguuugugguuuguuuauaacacggggccuuaccuggggaauucagcugguuugaauauuuguagcccgcucccagaaugucuuauuuuguaaugacugaacuacauuuaguaauaguuacacauguauaugguuaauacauauggaaauucaauauauuuuguaguuaacguauucugaaguaacggauguuucucgccaaucguagugacuucagcuaacgaaauguucuuuuguaguaccacgguccucggccuaacgaaggacgugaaccuuguaagaggagagcucugaaacgcggucaccuuuguuuaguggaagggaaaguguguucccggcaugaggugccucggaauuaguaaagaauugugggcaauggauuaaccacuguaucuaagaauccaccauuaaagcauuugcacagac

SEQ ID NO: 193048 - RNA, 23398 nt, Homo sapiens
uaguuuuagcaucacuguuuuaauuucaugaaauacaaguacaaaacauuguauaaguauacuuuuuacuacauggagaugaacuaauacauuuauguuuuuaucagaaucuguaucacccagcgcuggucaauguacuaguagcuuuccacagggauuuuuuauacuauuccuauaagguuuuaucaugaauaaaaaagcucacaacucuuuucagccauugcagauucacauuuaucuuaauauuccuguucaagaugcucuggagaacuguuaagaacuacaaaaucaccuuaggcagaguuuugaaugaguaauuuuauuucacguuggccaagaucucccuuauguuggcauugcaaagacacugcacuuaucugagguuagaaaaaauguagucuuaauagcccucuuaauguguagcaaggcaaauuaccauuuccuaaaauguccagaauaucauaguaguuaguuauucguuaagcaguaagucaugaaacuccacuuauagaagacaauagcaacagaggaccacuaaguccuaaauauaccaaagaaaaacaaguuuacaaauauucaaacugucugucuucucuaccucuaaaaugguuuaaccacaucaagugagaguaacaucagccgauuagaaagggaaaaaguaaacugugcuagcguccggcauucagcuuccauagcaugucucacaguuuucggccauuucagcuaagaguuuucuuaugacaggcaaaaauaaugauuaaaauaccauuagcuuugcugagaaauguggaaaaaaaaaucacaaugucaaaaauauuugaaacuaauuuuguuuuuauaaauaaauaaaaugguguuuaucuuuucuuaaaauucuugcuguuaaaacauucaaaguuaugucaaccuguaaggauaaagggguauuuaagauaacauguuuggaaaacuaaaccacauuuuuaauugccagcauuaugcuuuguucuugguagagucauccuuguuucuucuuuuuacaucccaauuauaaacccuggccauaucugcaagaauugucaaagaaaaugcaaaugcaauucuaaagauaaugcaugcaaugacuaaguauucacuccacucacacaaugaaucaaagacacagaaaugaaacauauacaaauacugguaacaaauaguauuguaagacauccugcuauaaugucaauuguuaggaaaauacuauaauuaaacucuaucaaaacuaaggacucaaauuaauuguuaacccauuguuuacuaugguauuagucaacugucagcuagucaacuaugauauauuuaacaaauauguacuagacacucucgauaguuuuaaagacagucccucauccaagaaaucugaaagaucacucaacccauauccugccauguaauauuuauauuauuacaauuaucaauaauuuuaucucuuacccucccuuuggcuuaacaaguuuauuaagcaucuacuguauuuuugacuaggcacuguacaaagcccugaccugaauaagacaggugaaguucuuuuccucguggagcuuagacuccaguagaaugucaauguaacagagacuguccacccuagcucccucacuugucugcacaccuuccuuuccuaccuuuugcaguacuagcaauaacaaauggcauuuaacuaagcuuguaggacucaucuuagaggauuuccucacuuuuggcuccuguacccaucuaagucacuggauccuguuuuuuucucacacguuuaauaucuuuuccuuuccacaagccacccguccuaggcccucgucaucucauagcuggaugaaguuuccacacuacccgucagaugaugaugaccacugcacuaggccccaacaggccugccuucccucagccaaccauaaacaacugccacaugcugcacacuggaaaagaagagaaagugcagcuccuacaucugaagagcucacgguuuggcaagguaaaacuaagcaguauguguuaagcaagcacacaagaaacacucugaggaucagaaaauguucaggaaagcucugaugcuuggacugagauauuuaggguaaaaggguaaaaaaagagcacauccuguaaauaugggaaagucauuccaguuaggaggaacaaaguguagaaaugcaaaggguguggcacaauuggggaguguguacaauaacugacugggguuaucuggaaccuggaaugcacuggggaaaggcaagaagaggucaguggcaugaggugagacaagcugggggcacuucacaagagugccuauauguauaucuuguaaguaacaaggaaccguugaaauauuguaaccagaggaauaaaaaugagugaccuaguaaauucauacuagagauagugggaaggacagauggaaugagaggaaccuaaaaagguucugagugcagguuuuggagccccagaacgagaacaguaaugggcagagagauuuaugagggaaauuugaugugaaucuggcgauugauuuauuauugguagugaggaagagagaagugugaaaggugacucccgugauuuugucuugagugacugugacaggaaguaggaggaaaagacaggccagagaagaaaggcaaagagcuugccuucccccuugaccagaauaccccacucccaccucuucucucugcugaucuuuaaacccuacgccgccuuuaaaaaagcagccuaacuuuuaucuucucaacaaagccuucuuugaacuaaguccagccuacaucuaucuuucccaaaguuuaaauugccuugguguugcauauguuaacuuacuuauaguuugcuaugaauuaucauucagcuguuuuacauguacaguucuaccagagaaaggcacugccacucuuuucuaaaauugauuuucaugccccauaugucuuagcacaguugcaggaacauaggagacccuuaaaugcuugugaaauuaaacuauuuaaccaguuauaaaguugucuugggaaaauauuuggaagaaaaauacuuacucaccuaugugaauuugcuguuuccacaucacauuucaaaaucacuaaucuaucuacaaacuuauuuaaguacuaguuccgaauaucuuauuuauuaucuuauaaaaucuauaaccuuuauauuagccuaauaaggaaauucuucccacuaaagcaauguaagaaagaaugugggagguuuuuuguauucuaauuuuuuuuuaguucuaggguacaugugcaggaugugcagguuuguuacaaagguaaacgugugccauggugguuugcugcaccuaucaacccaucaccuagguauuaagcccagcaugcaucagcuauuuuuccuaaugcucucccucugcccaugaaagaauguuuuuuuaaaaaaaucuuucuccuuuuuucccuugcuuuuuguuuuaagaaaggauacugacuucugugguaguaaauugaucucgaagaaagucaaggucuuccuccagggaaucaagauucuuuguggcagucgauaaauucuuuuccaacaaugccugagcuucaucaauaucauauucaagcauuacauuagccugaagagagaaagucaugacaauuacucaauauuuacacagagcuuuauagguuagaguaaagugugggcaaacuacagcccucaggucaaauccagcuugcugccuuuuguuguaaguuaaguuucacuggagcccagcuauucucuacucaggcuuucauaccacaauggcaaaacugagugguugagacagagaccaugugaucuacaaaaccaaaaauauuuaccauuugaccuuuuacagaaaguuugcugaccccuugguuaaagaauauauuuacauacauuguaucauuuaauccucaacccugcugaggccaaaguugucuucuucacaguuaaagaaaugaaggcucagguuuccuuagcuggcauagcuaguggguaaaugggagaaucaggauaagaaaccaguauguuuagauacaaaauccuaucuuucuacuaccuccaucgugaaacuaaauaguguuguuuguaucaauuuaaauaaauucugagcuugagauaugauauuaauuuaaaauuuuucaaagacauuuauuaucaucuauauuugaccagguaaaaaagacagcuagcuuuuaccugucccuuccuacuacuucugacagauguuagggauuaagacaagguaaugugucugucauucugaagaucuaguguuacugccaacauucagggaugcauguacccuggaauugggaagccacaccuuuuacagcuuugaacucucccuaucaccugacuuaccacuggcauuuccuaaaccacuuuccucaucucacaaaugcaauuuuaaaauuacucaaaggauuguuguaaggauuaaacaagacaacaugaaaguauuuggcacaaaguaaaugccaaauaaauacuuauugaccaaauaauccaauccauaauuagaaaacuguauuaaaauucagauaggacaaaaauauucaacauaagcaaagacugaacauaaauauaacaagaauccacaaagaaaaaaaaaccaaagcaggggaccaaaaaaauuucuaaauccuucauuucaacaaaauguuccugaaaugugacacaugcacauacuacacacacacacacacacacacacacacauacacacacacacacugggugaaaugacacgcaaaaugaaaugaaaggguacuuuguauaccugggggaaacugacccaaaaguccuuugagcauccaggcaaaaagaacacaucacucauagaagaaagaaaucaguuugcccucacacuuuuugacagugaugcuuuacaacaaaagaaaauggggcacuguauaagaugcucaaggaaauaaaaugugaguuuaagauauuauauccagcaaaacugaauuucaaguacaaaggccacagacaaguugucagcaacaugagauaacucagggaauaucauucccauaaaucuuaaggcaaucuacuuaucagacgaaugaguaacauacaaucaaaaugacuggaugaugacuggggggacaucaacauaaagacuaugaugugcauucaauauuuacacgaagaacuaggauaaaugaaagaugagagagagaaagagagagagcaaacaguauauaauggcucugugcuccaacaaugugggaacaaccuuauaaagaauguguaaggacaggaagaacauaugcaaaaaugucagugguaacaguguugggugguguuauucuaagaaugcuuugcgugugaauaguaauguugucuagcuuaauucuaucacccuugguauuucugaaaaccaggauucuugauauagaagaaacaggggggccaggcgcgguggcucacaccuguaaucccagcacuuggcaggcugagaugaguggaucacuugaggucaggaguucaaggccagccuagccaacauggcgaaaccccgucucuacuaaaaauacaaaaauuagcugggcgugguggcacgugccuguaaucccagcuacucaggaggcugaaggaggagaaucacuugaacccaggaggcggaaguugcagugacccaagaucacgucacugcgcuccagcccgggcgacagaacaagacucugucucaaaaaaaaaaaaaaaaaaaaaaaaaaaacagaggaacaacuaaagugaaaacucuguuguccugaauuugaauuggagguaacaguaugaaaccaugagguacacacauauuaaccugaaccuuugcacacaaguuuaugcagguuagcuauauccuacugguucuauuucuccgguugaacccugacaacagauucguucacuuacacuuugcuuuaugcaguuuucugauuuuuuuguuuauauuuaauauuauauacauauagaaaaguauucauaucauaaauauauagcuugauguauuuucacaaacuuaacacacucauggaaccagcauccagaucaaggacagguuaucaccaacaccccaaagcuuccuugugaacauuuucaguuaccaccagcacccccaccgcaaagguaaccauuaaccugacuuacagcauaguuuugccuguauuacaacuuuacauaaacagaaugacacaguauaugugcucuuuugugacugacuucuauaguaggcaagaauuauggcucccauaacagcugucucauucuaaucucuggaaucugugacucugaugagauauuuacaucauuugucagagcugaccuuaauauacagacugccuagguaggccuaaucuaguuauaugagcccuuaagagcagagaacuuuuucuggcuggcagcagaaugagaaguuugaaagaucuaaaguguaagaaagacuagucauaucacugcuuugaaaacagaaaggaccaugagccaaggauugcagguggccucuagaagcugagacugacuccuggacgacaggcagcaaggaaacagggaccucaaccacagagaaccggauuuugccaauaacgugaauaaggcugaaaucuaauucucccccagagaugcuaguaaggaauacagcccuguugacaauuuaauucuggcuuugugggacccugcacagaggacccagccaagcccaucuggauuucugaccuauacagcuaggagauaauggauauuguuuuaagccucugaguuugugguaauuugcuaugcaguuucuuucacucaaccuuguuugugaaaaucacccuugcagugcuggcguguagcagcaguucauuccuccucuguacuguauaguauuccacagucugaacacaucaugauuuacucauccauucgacuaugaugaacauuuggguuguuuccagguuuugguuacuacagaguugauaugaacauucuuauaccuuucuuuuaguuaauauuuauacauuucuuauauacagcaagaggcagaaagagauagagacaggcauggaacugcuauggcauaggcaaugcauauguucugcuuuaacagauacugccaguuuccccaguggcuguguccauuuacaccuucaccaacaguaaaucaguguucucacuauuccauguccuaccaucacuuaguaucacccuaccauuccgguggguacacagugagaucacauugugcuuuuaauuugcauuucccuguuuacuaaugaagugggacaacuuuucauauguuuacuggccauugggaggcccucuuuuuggaagucacucacccauuauccugaggaguugcuuaucuuuccauguuauccuuaacaaaaaaguuuucuaaaaaauuuaaguauauaaauauuaggaaaaaaauguuugcagauuuggugaaaggaguacacuguuaagauaaaauuauaaauaucugauaaagucgauuacauuaaaauuuaaaacuucuaagagcuaccacaaaagacaagugacagaugagaaaaaguaucugcaauauuaagagaagacugugcauccgaaauacauaauauauaaagaagaccuaaaugucuaucaaaaaaaaaaagaaaaagaauccaacagaaaaauggagcaacaacauaaucaggaagggaaacagaagaggaaauacaaaugagcauuuugucauacaaaaaccuauaagaugauacuauuuucaccuauaaaacuagcaaaaaucuaaaaaugugggugagacuguuaauaaaaggguauuuuuauauacgguuggagaaaaugaaaauugguagucuuuucuggagagcaauuugauaguauccaucaacauguuaaaugugcauacucuuagacacaacaauuccauuucaaagcagcauacaaaaauaugccuuuguauacaagucuauacgugcaaaaauauuuacuacagcaccgcucacuguacaagaaauuuuaaaacaauccaaacaccccuugacuugggaauauuaucacauagcccuaccacagaauaguaagccaauaaaaccaaggaggcaaacucugugucuacucacaaauaaagacaucugugcugaacaauauacaauauauaucccauuuuuguaaaaacaauuaacaaaauuccaaauauuuagguacauacagauauacagacaugauuaaaagugggugcaucuggggauggagcaguagccugcugcuuucuauuugcucuuugaaccauuagcauguaugaacucugaugaaaaacuaacaaaaaugucauucacccaagaaaaauuuuuacugagcacuuauuaugugucagggaacugguaaauacaccaaucaauaacauaucagggagugcuaaguacuuugaaggaaaacaauacaagauaaacaguacaagugaaaccaagaaaugcugacagacaagucauagcaggucccugggggagcuaacaaucggaacugagaacucaaaggauugagugugaagaacacagaaguagaaauguggggccacacuggcagguuccaggaacaguuagggggccaccauggcuacagcagagugagcaaaagaaugagcauaaaugagugcugagagggaguagggcuguccuguggaaaggacaccucuguauuccacccuuggugacagggaaaccacuggggucuugagcagaaaagcggaaucaucugacauguuuuaaaagcacuacucuggcagcuuaagcagaagaaagagcuagaauaaagguucugaggcagggccauucccagcaugcucuaagucuggcaagaaguccaaguguggccaagcgaggaaguaagagaagaacagagagacuggacacgguggcucauaccuguaaucccagcacuuugggaggccaaggugggcagaucacccgaggccaggaguucgagaucaaccuggccaaaauggcaaaaccccgucucuaccaaaaaauuuagcugggcaugguagcacgugccugugaucccagcuauucaggaagcugaggcacaagaaucgcuugagcccgggagacagagguugcagugagcugagaucacaacacuguacuccagccugggcaacagagugagacucugucucagaaaaaaaaaaaaagagagaaguaacagagaguaccaggauguauaggaacuugucagccacucaaagaacuuggacuuuuccucggaaugugauaagaaaccauucaaagauuuugggcagaauaauggaaugaccugauugagauuucaaaggauuaaucugaccacugugcuggaaagacuuuaggaauuccagcaagggcagaagcaagacagugaauuaggguauuauuauggguuaaacaguguccccaaaaaagauacauuuaaguuuuaaccccuuauacuagcgaaugugaccuuacguggaaguaagguauuauggauugaauucugucuccccaacaaaaaauaaguuggacuacuaacccccaguagcucagaaugugacuuuauuuggagauaaggucuuucaaaaggagaaauuuggacacaugcaugcacacaugugaagaugaaggcggagaucacagugaugcuucuacacaucaacaugccaaagacuguccgcgaacaccaaagcuaagagaggaggcuagaacagauuuucccucacagcucucagaaggaaucgacccugauucuggggcucaucacggacuucuggccuccagaaccaugagacaguccauuucaguuguuaaagccacccaguuugugguaauuuuauuauggcaucccuaaaaacuaauagacaguauucccacaguccuggcaagagacaaagguggccuggaccaugguaacagcaguaaggaagugagagauaguuggcuucucaaucuauucagaagaaggaaccagugggguuugcugaaggacugguugagagauauaaaauaaagaagagucaaagaagacucaaagauuuuuguucugagcaaccaggcaaaagauucugccauuuacugagauggagaagauugugggaagugccagucuaugaguggugaaaugaggauuuaaacauucaagaggaaugaaagaagaaaaacaugaaaagagcaagaagagcucagcaaagaaaaugaagagaaagagaaacagaagaacaguuacgaaagacagaguaaaagcaacaaaacagaauaacuaccagggaaaacacaaagucauggggaagcagccagaggaaaucacacagaaugaaacacaucgaauaacugaaaacagagaacaugauagguacugaaaacagauaaaggagaucgaacauaugcauauuuauuauucccaaaagauaauaaaagaaauggggcaaaagucacauucaaguacacaacagaaauuaucuuuccugaaauaaaguaacacuugaauuugugaaucaaaaggucaugcaauuucuacaaaaaaacugaauacagaaaaucauugaauccuuggacacucagguguaguugcuaugcuucaaaguuauuuuuuaaaaagccuuagugauaaauuauaaaagauaaauacugaaaugcagauuguagagugaaauauaaauguuguacaaacuuugagcaaaccuccuugggcuaaucuagagugccucuccagagugauccuacaggacagcagcuaggggaaauccuccccguaggacagcugguagaaguacacuuggcuugcuacuuuguaugagaacuugccugagguaacaagauccacagacagguagcuggauagucagaggacugagaagagcaaaauagguaaaucacagauaagcucaaugaaaucaucuaaaacugaaauacaugguuuuaaaaaauaaacucuaaccucaaacuuuuugcaauacucuuuuuccccuuaaauugagagggaucuuucuagaauuauuaaacucuuaugggaagaagcguuuaucuaaaguucagcaguaccuucuauuuuacuucuauugcucuuccuccauuauauuuaagagagauaaagcacuaacuggaagagaagcaggguuuguuugaucaguuuuaucuugauugggagagacuucaguauguuuuuacugcgaucuucaucgcacuucugauucuagucaauuucuaauaugaaccacuuggacucugucccuuugucccuuccacaaucaaaaggagaugaacacuuuacauaucucgagcaauacuacuaaaauacuagcaaauacuagcaaaaccaguguguuugcuacagaaaacacacugguuuacaaauauaucagcuguggcuauaacauuuacuuacccccaaccacagacacauuuuaucgguaggaggaacugaagcuuugcaauacagguuaucugccagcaagaaucuggucuccauugaguugguggacuccuucaaaacaaaaaaaaaaaaugacaguaccauaaacaggccaguuugauaccaagguuauaaaggagagauugcacaguugaaccuaggacauuuaaaacaguaccaucaugcaggcuaaguguagugguaaaagaaaugaaugcuagacccagguggcuggguauggacucuggcucagcuacucacuagcuguacaaaucuggcaucucacuuaacuucuauaucucagguucuucaucuguaaaaugaggauuacaacagucccuacaccuaugaagucagugguaagcacugaguauacacagacacacacacacccccgagugccugacauacagagaaggcauuauuguaagaauuagccauucuucuauuauuucauuggugcuucaugcccaaucaaucaguugcugaagucuuacaaaguucaccacauauuaaaauguacuagaaauaguuauucuaccagucaagcaaaaucauaagcauacacacaaucuuuuaaauacaauaugcuuaugagauuuaaucuuuacaaccugcuuuuauuuaaugaauacuggauuaagacuuagaagacucucaaauuuaguucugccaguaacuaacuacauagacaauggucgaguauaaccucuccauaaccauuuccucaacuaugaaaugagaaccuguaacagaugaucucuaagauucguuccagcucuauaaaucuuggacuaacuccuuauucuuagggagaaagacaacaacaaagaaaaaacccuagaugcugcuagcacagaauaagacauuuucuuuguacaccuaaaacaauuucaaauugcauuuaaguuucacaagcacuaaagauaagcaaaguaauccaagugugggcccuagaauuaaacuugacuuuugggggaaggccacaaagccacauuugcuacagaagcacaucauaacauuaguguaugugcuuaagaaggcagacuggauuccacagcacagaucaaauaucagugaccaaagagucaaagaagacgaguuucugcugacauauccuagcuugcucauauuuacaaacaaaaaugcacuuacuuuuuucuucugcauguauuuuagaauuuccaaagucuguuuaauuucaggaaucugaccuuuuagccugugaacaagaaaaagaguaacuuaguauuuugcaggcaaaaauaaacaacaggacacggucuuacuaacuuugcauuuucuacuaauguguucuugaggacuauuuauagauauaaaauacuuaagauauuuuuagauaugagauaaaauaagauauaaauauuuauaaaaauaaaauauuuaaagaaauauucaccaaaagaaaauauauuuaguaaaauauucauaaaauauuuaaaguauaaauacuuaauaaaaauauuuaagauauacuagugaauguuuauggaaugcccauuccaugaagacaaagcucuguucuauuaugucaaauaccccauggcuauuuaacauuucuagagcagacuauauuccacagaggugauucauagguucugcauuugauuagaaugaaauuuuaaauagauuaauuuuaaaacuaauuuuaaaaauaacauggauucaaaaguuacauucuaaaauagaagacaccaauccccuauccagugaugcacauagcuacuccuggugugugcauuggguauacacacauguacaucacagucagcuaaaugccaggcaaagcacagugacaccuucucaguaugugcacuugucacacugugaaaaauguacagaaucaucugaaugccaaacacaccacauuaugauacaguauaauuuagugauucuuuuaagcuuuggguauuucuuccuuaacuuuuauguugauaaaugcucuucuuuucaaaugagguaacgaucguucuuaaaauuauaaauggaucacugauuuaaacacaagaaauuuaaaaaaacaaugauggacaugauacaacugauccgacuuaauggauaaguuauaugauagcuacuagcaaaaugcuaguaagugacucccaaaugcaaucaaccucacugacaagaacauaagagaaaaacaguaugcuaaaaacauucagucaauuaaagagagaaaacaaugauaccguuuuugucacugggguuuagcucuuuaugguaauuagaugcauguguuuugcauggagauauaugcaaaacaguucuagggucucugucaaauguaauuucuagcaaaacagacuaaggauauaaaaacgaagcucugguucuuucgagguaaauuuacuaaauauuauuagagaccaaaauguaaacaaaauauaaacacaacaaugaaaaugaacuuauugcgucacauaaaagaagucacuccaugugugcagcagguuggcagggcaaauuuacuacacccugugcuacugaccuggcaagaaauguguuaaaugagccugcugcuuaagaaaaaaacauagugucaucauuugauaauacaguccagugaauaaucuagaaacaccuagcauucauuuuuucacuacaauucaaucuggaugccauagauugcucaaguuugcuuauuuuugcaugauauguucauauagguaaacagaaagauguuauacauuuguaaaauaugugauacacacacaacauaaggaguauguucagaucaagauuuuuugucauguaaaugacuuuuaagaugcauucuguauauauaaauauuauauguaauaugcuauaaagcauauuaaugaaucaaucagaugcagcccuagcuaacuuaggaaccagaccaccaaugacacagcacaugcccaagcaauacacuccucccuacccugcuucaccugaagagaaaguagcuuggcugggcacagugauucacgccuguaaucccagcacuuugggaggccgaagcggguggaucaccugaggccaggaguucgagaccggccuggccagcauggugaaacucagucucuacuaaaaaaaaauacaaaaaaauuagcugggcgugguggugcaugcuuguaaucccagcuacuugggaaguugaggcgggaggaucccuugaauccaggagguggagguugcagugagccgagguagcgccacugcuacccaccaggagugacuuaaauuacccccaccuccacguacauuacuggccaaaguagcugauaucccugagggaaucuaagcugacagggaaaagacauuauaauuugaucauuauaauaaauaaagacaauaaauucaacaaccucuaccauaugaaacaaaauuaacaaauaccaaaagauaaaacuauacauuaaauacuuaaagauaccacaaagagaaaagaaaggauauugguaauaugaagaggaaccaaccagaacuaccagcuauaaaaaucuuaacagcugaaacaaagaacucauggcuauccaucuaauugccaaaagauaaaugacaaagacagaaaaaagggaaauaauauaaauaaauggaaggcagaauuagaagugucaacaucuguaaacaggaaucccagaaagaaagaggaaaaaaaauuaacagacgauagaaaaagugauaaucacaaaauuuccaauuaaagaaagauaaaagaucucagauucaagugucgaaaaagagauuaacacaugaaauacuaaggaacuuuuacacagcuugaaggguaaaguuaaaugacaggcugcaagauuuacaacacauacaaagaaaaaggcuagccucacccucacccucgcccucgcccucuuugcauggucucccucugaugccgagccgaggcuggacuguacugccgccaucucgacucacugcaaccucccugacugauucuccugccucagccugccgagugccugggauugcaggcacgcgccaccacgccugacugguuuucguauuuuuuugguggagacaggguuucgcuguguuggccgggcuggucuccagcuccugaccgcgagugaucugccagccucggccucccgaggugccgggauugcagacggagucucgcucacucagugcucaauggugcccaggcuggagugcaguggcgugaucucggcucgcuacaaccuccaccucccagccgccugccuuggccucccaaagugccgagauugcagccucugcccggccgccaccccaucugggaagugaggagcgucucugccuggccgcccaucgucugggaugugaggagccccucugcccggccgcccacucugggaagugaggagcgccucuuccaggccgucaucccgucuaggaagugaggagcgucucugcccggccgcccauccucugagauguggggagcgccucugcccagccaccccgucugagaugugaagagcaccucugccccgccgccaccccgucugggaggugaggagcgucucugaccagccaccccgucugagaggugaggagccccuccgcccggcagccgccccaucugagaagugaggagccccuccgccuggcagccgccccguccggcagguggggggcagcccccgcccggccagccgccccguccgggaggugggggggugccucugcccggccgccccgucugggaagugaggagccccucugcccggccgccaccccgucugggagguguacccaacagcucguugagaacgggccaugaugacgauggagguuuugucgaauagagaagggggaaauguggggaaaggaaggagagaucagauuguugcugugucuguguggaaagagguggacaugggagacuccauuuuguucuguacuaggaaaaauucuucugccuugggaugcuguuaaucuauaaccuuacccccaaccccaugcucucugaaacaugugcuguguccacucaggguuaaauggauuaagggcggugcaagaugugcuuuguuaaacacaugcuugaaggcagcaugcucguuaagagucaucaccacucccuaaucucaaguacccagggacacaaacacugcggaaggcggcagggcccucugccuaggaaaaccagagaccuuuguucacauguuuaccugcugaccuucccuccacuauuguccuaugacccugccaaaucccccucuccgagaaacacccaagaaugaucaauacuaaaaaaauuaaaaaaaaaaagaaagaaauaggcugaacucacuuaugaacagaaauucaaaaauccuaaauaaaauaauagcaaauugaaaaaaaaaaaaaacaaaaaggcuagcauguaaacuacauagagccaucugcugcaaaacaacuagaucaugacacaaaaauaguuuuguugcauagcugacaucauaggagugagagaaauuccagaaaaauaaaaagagaaaaguagcccuccaacuacuugggaggcugagauggaagaauugcuugaacccaggaggucaaggcugcagugagcugugaucacaccaccgcacucuggccugggcaacagagagaaagccugucucaaaaaaaugaccaacccacuauuaaaauagguaaaacucaagaaaauuuuccuaacucacuaucuccaacucuaccauucucuuuuaaaacacuagacaaacacuguucucauccagaacaccaacguucacugauguuuccuaagugcuuugaauuuuuaccccuucuccccacauuuaggccuagaccauauguuaagcuagagugaguauccugcuacauaccacaguuguagaguuagcaauauaacuuuuuucuuuuuuuuguuuuugucuaucauuaauuuacuaguuagaagagcaauuuaaguuugauacgcaaauuucccccucucccaggacuuggucccaaggcccauuuucuuuuccuuuuuuucuuucuugagacgggguaucaucacucuguugcccaggcuggagugcaguggcacacucacagcugacugcagccucaaccucccuggcuuaagcaauacucucaccucagcuucccuaguagcuggaacuacaggcaugcaccacaacaccuagcuaauuuuuguagauauaggguuuugccacguugcccacacuggucuugaacuccugggcucaagcgauccgcccaccuuggccucccaaagugcugggauuacaggcaugaaccacugcaccccgccccaaggcacauuuucuucucuaucuguaaccucccuguaggugaucucaaauccaauggcuuuauuuuucuuuuucaaauaaacuuuuacuaucacaaaagcaguacauguacauuguaaaaaauuaagaaaacagcuaagcaaaaacaagaaaaaugccauauucuaacuacccagagauuaccacuguuaauaugccuuuaguguggauuucuccagauauuccugugcauacauacauuuuuuuccaaaacgagagcacacuguucuuaauguuuucuaucuugcuucuguccauuaacacucuccaucuuuccaugucaaugacuuuucaucucaucuaauacucaguacauauucaacuuuguacaacugucaccaaaaucaaaugagaaaauauaccuacaaacuucuguaccuuugcauaaauggugccuuaggcccagacuaccccuuccucacuuuagucugccuccaaacucacaacuaaucuuugaaauucuacacagcuaucuguuccucuuagaagcuuccucugaaccuccuuggccccuccagguuaaugaggugcuuugguacaaaguaaugaguuaccaucccccuguaccucuacuguucuacuuugugugcuaauuuuauuuauauaccuauaauuuccaccaaacugugucccuaguuuuuugugugguuuguuugcuuuuuagacugggucucgcacuuuugccgaggcuggagugcaggggcaugaucacaucucacugcagccucaacguccuggguucaggcgauccucccaccucagccucuagaggagcugugaccacagaugcaugccaccauacccagcuaauuauuacuauuauuauuuuugagauggagucucacucuguugcccaggcuggagugcaguggcacaaucucggcucacuacaaccuucgccucccgggcucaagcaauucucccaacucagccucccgaguagcugggauuacaagcgcaugccaccacgucuggcuaauuuauuuguauuuuaguagagacgggguuucaccauguugcccagggugguuucaaacuccugagcucaggcaaucugcccaccucagccucccaaagugcugggauuacaggugcgagccgccgggcccagccuaauuauuuuuuaauuauuuguagagacgggggucucccuauguugcccaggcuagucuugaacuccuggacugaagugauccucccaccucagccucccaaagugcuggaauuacagguuugagccaccaugcccaguccuguguccuuguugaaagcagauacuggauguuauuucacccaaaacaguauguggcaucuagcuggcauuccauaaauauuuaucuuacagaagaaugcuggcacaugcacaaaacagagaucuauaaauauuuauuacagugaauugacuuuauaagcuauauaaaauaauguagggaaauaaagaguugagaguaaggauagcuuuuuuccuaugccuauuaguuaugaaaucuugggauuucauaacuaauuaagucuuaugcccagacucugugggucucuaaucucacuggcaaaauuagaaggaugaacuagacauauaagacguuaugauuuugaaagcuuuggaauacagucuuuaacaaccauucuauuauguuuucaaaaccacauuuagacuggcaauaccaaguguuggcaaggauacggaacaacuggaacucuuguacguugcuggugggaauuucauaugguacagccaccuuggaggacugaacacuugacaucugaauauuuuauuauauguaaauuauaucucaauuuuuuaaaaguucaagucauauaagauuuucaaaacuuagaaauuuuuacacuuaccuucuuuucuuuugagcaagguugaguuccauaaacuuauacuucugguacuguucauccagcuucuuuaauacuguaucugcagucucauucccaggcuguuucaugaaggaaucuacaucuuccuuuaauaucaaaaauaauacuuuacaaauuuuagaauucaugccacucagauuuuuugacugcuuuguuuuuaaaacauagaagaaaaaaaagcuuuguuuuucuccaaagguuuguuuuuaacuaaaaguacagguuaagcacccuuaucuaaaaugcuugggaccagaauuguuuuggauuuuagauuuuuuuuuuuuuuuuagauuuuggaauauuuacauuauaccaguugagcauccucaauccaaaaauccaaaguccaaaaugcuccaaugagcauuuccuuugagcacuauauugguguucaaaaaguuuuggauuuuagagcauucuggauuucagauuuucagauuuaggaugcucaaccuguaguuauaaaaaguuagagacaauuucagaugguacauauauauuauauagcuaauuuauucuuucacuuuccucuucauuuuuuauucaaaaauaggaaaagaagaaugaccuugcccaccacuuuaugcauuucccaugcaucccuaguaguaaauaugaaacuaacaaucaaauacauugccuauucaugcauccuauucacaaaaugauuuuacagguugcaugucaagauuaucaauuuuauuacuuauuuuuaauucaacaaguuuuaccauagaaaucauacuaaauaugguuacuggguucccaaggcaauccacaaaugcuuccuucaguaucaaauaacugaaacaaaguaaaccuaaaaggcaaacagaauaaucuuuuguaacaguaauaacugaucaaaagaaaagcaguaaaacugauguuaaaauauuuuuuauaccacaugcugauccuugaagaaaggcuaguuaauuagauaaggaucagaaacaagaugaaaauauaugaaacuuaaaagagaugcuacaagagucgucuaguacuuuacagaacucuaguucuuuauuauaaguaacuucaauuaucuuauagcuucuaagaucuucacaucauuauucuuauccauauuuacuagcuaccagagaauaucuuagcugaaacaaggaagaaaaaggaagagaaacacagcaagggagugaacuaagaagccaucaaacuagacaguaaaggaaauugaaaaggugaggcugagagauaauggcugaguucuguauguuaaagagagaugccaucuuccuagaagggucacugcagggaagagaaagaaguguaaguuucuggcacaugauacauguuaucaggugcuggaguuuagcaagaauuaacuauagcggcauaggcugugguuaagagacaggaggugccugguuugaaucccagcuucgccacucauuagaugaguugaccuuagggaaguuauuuaaccucucuuugccucaauuuccucaucaucuguacaaguaccuuuucgucaccagggauuaaaugaguuagcauaugugaaacgcuuauaagaguacgugacaccuauguauagcauaaugugccacagggacacaaagugccagggauuuuguuuugggguagaggucagagaaaacuacagggagaugauaucugaacuagauguggaaagaugaagaggucaugaaauggacaagggugaaacaacaauucaagcagagaaagaaaacaaauuacugccucagcgggguuggggaauggacugggucugacuucuaaccacuaugguauauugcuuccuaucaucaugaauauuaauaccuauucgacaccuacuacacugcaauacugcaagcauguucucuguuucccauaacaacucucuaaguauugucaucccuauuucaguuaaagaaacucaagcucaaagugguaaaauaauaugcuuaagguuaagcagcaacugggaagcagagccaggauucagacccuggucuauuuagaggccaauaaucuuucuacaauaccaugucacuucaauuauuaauaguuuggaaacauaaacaguuauauaaaauuuggguugcuuauuacauuauguugguagaaauuuuaaggucuagaaaaaaauaaccacgacauuguagggaaaaagcauuucaagacauuauaaagcccucagauaaagugucuccucccgaguuagauuucugacgccaucucuagcugagcaccaugaauguaacauuuaaggcccuauggaaauucaauuagacacuuaguuugagcuuauacuaugugugaggcacuaugcuaugaccaggagaaguagggcgauucaugagaacuaccucaccuccucccaguagcagagcaugagggguaagcugccagucuggaccuccacggauuguccaaguucaaacccuggauaccucacuuacauccuguguggccuggggcaaguuacucaagugccccguaccucaguuuuaucaucuaaaaaacgggcauaacaguaguagcuaccaccucgaauuuuguaaaaucauuaagaaagugccuggcacucaacaaauuuuauuccuuguuaugguuagauaauagaucaauguagagaaauaaaugacacagcucauaaaaacacaaaauaauaaccaauuacgaaauucaaucagcaaaugcgaauauacaauaucaagugugguauaaauaaaugagucuuuagaaggauauaagacguaguuaguaaaaaaaaggcagagguaagguaagguacaaaccaaaagauugagaaacuuccaugaagauuuuauaguagcuaaguggggacagacagaugaccuggccuggagggccagucagauguuuucucucauuagucaaauaguuuucaacuacuauuucuaaauuaaauaaauaaaauaaaauuuuuaaaaagccacccagcacaggcagcgcccuccagaacggccuguggagcaacccgauccccucuaggacacuagcgaaccugggaccuagcgccaucaggaggguucagccuccucucucaacaauucauucuccacuaaguuguuagaaugauguaguuaaaacgaaaggccuucugaugacagcccguugccuacuggaaaaccucaauuccuuagcaagacacagaaggacuuuacacucccaaccuaucauccuauuuucccaucggucucuucuuccauuucccgaggcaacauucccgagaccacugcauuccuucaacagacaaagugauauucccgguuuucacaucuuagcacuggcuguucugccuauucauuguacugugucuccagcauccaugcugagucgagagcuccucaccaccuccccuuuuccaaccagcagggggacgaaaaccggcggcagcccggaggucccucaggccgcccugcccugccacccgccgccccucgccccucgccccucgucccggccccgcaccccguucucuucuacggccuucucgagcuacguuucuuccgggcgggcccccagcagagcucaaucuguccaggugcgaggggugagagcagaccgagcgcccccucccugaacacuuggcucagcuccuuccaacagucgaggccugggugggagccgggaagaaaggggcaguccaaggccucaagccaagaugccagggaacagcgugccucuuaccacaaacacggccucaggaauccccagguggagccgccgcccauucccuguggccauuucuccuuugccacaacuguccuuaacggccgccaucuuggggaugcgagcgcgcgacugccucccgggccgccggccgccgggauuccgugauu

SEQ ID NO: 193049 - RNA, 43659 nt, Homo sapiens
gguaagcuuaccgugaaaggaggguuugggcuguuguugcuacacguggaugugaaaugagucaagcggaacuuugauuacaaggaauuucauauacugugaguguguaugcaggcugggggcugaggggcgggggcugaggggcggggcugaugggcgggucugaggggcgggggcugaggggcgcggggugaagggcggggggugacgggagggggcugggugagaugugugcucugcgcugagguggauuuguaccggagucccauuugggagcaagagccaucuacucguccguuaccgggugagugugggaacacccccugguguggcaaggcggcugggaccugcggcaucuaggugcagaaguacagaaucaggucaggaugauccugcuaggguaccgcaaaaucagaacaauugggaaggcgcccuguggcuggcugucaguccauccauuuguguccggagagcgcuuucugagguaucagggaucugggcugacaucucuaggaucuuggcgagccauuuccuguaggcucuuacuggaccugcauugccucugagaacaugccuggacguguccaacaaccuugagcaucuaggguugggagauaaagaagagaaggaggcuggguguuagugaaggcggggacaguggaucagacuuguggagcauccugaggaaagcagaacugcuaacccgcguggcuugagggcaagucagggcuuguguaaagagcaugcuggcucuguuugggggcuuucaauccacccccucacccgccgagcuugguuucacuugaucucucauuccuggaagcugagccccgggcaguguuauuuugauccugccucacuccaaacacuggccaagacccagcaagcugcaagaacugggggacaagaagggacccgccagag[450 bp omitted]caugcucaccauuuaacuuguguuaccauggacaaauaaaauuacuucucccuuucugaguuucuguuaacuucaggcuaaaguggauaauaauagcacccaccucauggggcuguugugaggauuagaugagauaauccauauaaaauacuugcacacacuuagcacaguggcuggcccaaaauaaacacucaauaaauauuaacuauuauuauuuaagauagacuguggcacacagauaagauuucaacagguggagauagagaagacaguuuaagcagagaaaauaggaacaacugcuuuaaggcagggaagcucagggcauaugaaaagaacaccagcugagcuggauuuuagaguacgauuagcggaaaauuggaaguuaaacuugccaaggcagauuggugguaaacugcaaaagacaguggaugcuagaguuuugauuugauuuagcagacaauggaaagccauugaaaguuuuugagcuuaaaaaaaacgucagauccucugcuuuaggaagaguaaucugguaaaagguuagucagcuggauuggaauaggaaaacacaagagggggauaaacuaggggcagagagggaacaaggcccuggaacugaggucguggcugugggaauagaaaggaggugaugaauuuaacaagccaucacaaaaguugaaucuacagaacuuuguaguugauacauuauauggaauugaaaaaggaagaaugagaaaaucagaaucuuuucggguuggcuuagaccuuacaagguugugcauucccaucucacuucuguggauaacgcaauagaaagaguauguaccuucugagcuagacacagcuauuuucaaguccugggucugcuauuuaucugcuguuugugauccuaagcauauuauguacuugacauucccaacuaggaucgguauuuccacaagacauuuagaaguaugugggguguguguguguguguguguguguguguuuuacacacagucugagguacuacugcauuuaaugccaaacagaugcaacaaauaauuguuccucccacccaccaugccaguaguaagcccaaugagaaguagucaaauucuuugagccucagcuuucuaaccugaaaaagagggauaacaguacucacaucaugguguuauugggaggauuaaaagauauauuuccugccaagggucuagcacagugccugacaaguagaauuucaugaauuguaauuuuccuuuacccuaauggauuccacauuaaaacauccuugccaguuucugcuugaacacuucuagagggagguuccuuacugcuuccugagagagcccacugucuucagggaaagccuuggacuguuaaaaguucuuccuuuugcuaagcugaacuuaguuuuccuaaagcuuguaccuggauauccuagucauucucccugaggccaccuagagcagucuguucuuuuucuuccaugacaguuuuucagagaucugaagaccagagaucagaucccccugcaucuucugcucccaggucaaacagcucagauaauuguaucauuucuuaucuggcaugguaucaagucaaauaugacucugugguuuugaaguauauaaauugggguaugaguaugucuucauagugaugaggaauacugcaaaaggaacaggauggguaaaugugacaaaauuccuuguaauuuauuauuuuuuaaauuauuuuuuucuggucaggaaggguggcucauuccuguaaucccagcacuuuaggaggcauaggcgagaggagggcuugagcccaggaguucaagauuagccugggaaacauggagagacccugucuauauaaauuuuuuuaaauagcugggcacugggugcugggcacuuguagugcccgcuacuugggaggcugaggcaggagaaucuccugagcccaggaguuugaggcugcagugagcuaugaucaugccacuacacuccagccugggcaacaaagugagacccuaucucaaaaaaaaauuaaagaauauaaaucauuuuuuccacuaugugcuaaauacuuucaaauccaucaucccacugauuccuuauccccaaaugagggaauugcagauuuauuuauauauauuauacagguggccaaacaggccuagagaaaaugaaacuugcuagagaucauuuaguuaguaagcaucugugccagaacugcaagacacauuuuucuuacuccaaguucaguauggcuuuucauuuuccacagcuguuaggguuuaaggugauagauagcugggcaauuacgccaacucuggcacuaaagaaugagucaaaaaaaagagggauccuccaauuaccuuauaccaguuauucccucuuugagagaauuccuuucuuuagaugucuucuugaccuucuccacuugaaugcuuccugcagagagugagucaucuuuuggagccauuccucagugcugaagcuucauauugaagcagaagcugcuuuucacugcuuucuuucuagaaacuagcuccacccguguauucucuucuugggagcuuaacaggaaagauauggguaaguuucaccaucaguauguaaaauacgacuacuauuauuuugugaacauagauaugaggauggcuauacuuugucuuggauuagaguuuacuguauauauuuucuauguuccccaccagacugcaaucuccuaaauuuggagaauaugguuuauucaccucuguuuuuuucucuugccacuaaguucuaauagaaugccuagcauagaaaguacucaucaagugguugcugagugaccagaaauuaauucucccuaucuugggaugacaacaguuauuauaucuuccaaacaccaccaaaagacaucaugcuauucucaaaaauaaaggauuuuccauguaauauaugguggaaucagacacugagauguccuacuuccaggagauuguuagucaccguugugguuaagccaaaaagagugggcauuacuucuucccuucuacgauccaccucuccaugacccagcccacccuuuggaauuguuucuguugaggauaaaaugagccauuauugggcugugggaguuaggaaaaagaagcuggagccuugguaguauagucacugaguaauugguccuaaagcugggccaacuccuuucuucguauaugggaaguagagaagccacugggcccugaauaugcagacuugaauucuacuuuuagcucuaccauugaccacugugugacuuugggaaaauucuaucccuuuucugagcauuaguuuccucaucuuagaucaucagggaaugggguuaaguuguccugaauaauacuuuuaggaucccaugacuauauguuuucaauuaucugauagcuugaaguuuuaacugguugccaaagaggaggaaaaaaaaaacaaaugauggaaugugcugucuuaugaguacugaggugccuguuacuaaaggacuucaaguagagcuggaugguauuucuuuacugggcaaaaggccacugggacuaagauuaauuuuaaaccucccuuugacucuaagauugucagagucuaaaaauggucucaaagaaugugcauuuacauaugaggucauaggcuucuuguuaucagucucaccuucccuccacaaccucacaaaguacuauaccuuucucccuuuucuuggacaucuaaagaaaaaaugaagaaauauuuuggcagcagcauuucauuuuguacagacaugccucauucuauaguucucauuguauucuuccaguccuuuguuaaggauguggaccuggguugggcuuguaaaugcccacugguuuguaucucugcuccuuuaggauauuuuauucccaggccuaugaggaugggauggaguacuugauugccaugggaaaaaaaaagagacuguucuuguugacaucuucagauacagcuauuccagauugcuugguaaaugggacaggguggagggaguguggggcaagaccaacaaacuuaauagaaaucagaaauuggaguacuugacugaguuuuauccagucccaauccugcaaauaaaucauaccaugaauucaauacccaacugggacaacucagccaaaagccuucuugggaagucagcuuaucuccccuuccaguacugcugguugaguaacuaauuuuuuuauuauaccguaauuuuauggaaucuuguggugauugguacaugaccagugacucacuuuggcuaggauaacagcagagcaaagcaagagguuucagguguuagcugagugccggucuggcuuggggcuugucuccaauacccuuuguuccccagcucugggugggauaguaacaacaaucauagcaacuccucacauacguagcacaaucuggaguuuccacagcacucucacauacauuaucucauuuuacccuugaacauaauccaggguaguuucugugcuuuugcucccacuugggaagaguauuuuagcagucaguagaagaacguuuucccucaaaaucagccuagaguuugcuguucuuaauuucauccuauuucuuuuauaaugguaucuuuguauucuuggcuacacagucucuuuuccccauucguuuaacaauuauuuuucagcaguugccaaacacuaaccaaauauuuauauuuuuaauuuacagucugcuaaguuguauuugucuuuugagguuugugcuuuguuuguugucuuugugcacguacgcauguuuugaaggcaaaacaauugacucauaugguuagcauuuacuuuuggccaaguggaaguagcccaguucaguugguuauuaauuuugucuguacaaugacaacagcuuuuaguaaggauuuuuuuuucuuuuucuuccccagcuggggcuuuaccucuugcucugugcgcuagaauaaaagacaaaggagaauagaugagacuucuuuaauuuugcgcagguucauucuccucuguugauauacuauuccugacauugcugggccagauguugcuaucacuaacaguuaaaauucuucagccacuuuggaaauguugaaaguagcccauuaaaaacuguaguacccaccuguggucucuacauuaugucuauuccaggcacagauuuuaguauacuuaaacacaaaaagauaauuuacuuuuaucacaugcccaugaaauaaaauaaaaaugacacauccucaguccuggccuccuccacgucccaguaucaauagcugacacauuacucaucccuuacuucuuaaagcuuuguccuauucuacucuaucaagguucuuuuuuuuuuuuuucuucucuggcuuccccuucuucguugcugucauguauuccuccucuuccagcuucaaguaugagugacccucaauguuugguucuucuuccucuuucuucuuccuuccuucuuccuucuuucuuccuucuucccuucuccuccuccucacccuccuccuccuccuccuccugcuucuucuucuucuucuuuguuugagaaucugucacccaggcugcaguacaguggcacaaucucggcucacugcaaccucugccuccaggguucaagcgauucuccugccucagccucccgaguagcugggacuacaggcaugcaccaccacgccuggcuaauuuuuguacuuuuaguagauacaguuuuucgccauguuggccagacuggucuugaaguccugaccucaagugauccaccugccucgaccucccaaagugcugggauuaccggcaggagccacugcauccagccauucuucuuuacccaugauuuaacuucugccaugauuuacuucggccagugguuauuccaaccccagagguuuuuauuuaauuaaucuagagcguaggauuuuuuuuucagugcuccauaugauucugaugugcagccauaagcaagaacuguuauucugguguuuuuaugcauuugacacaucuccaacuucaacuuauauuuuacauauuguauaugcuuguugggcaugaccacugaaauguuccucuguccccuucaacuucucuauacugaaaauaauugaaaaacagugcauuuucuuuucuuuuaccaagcugcgcuccuuucacgcuucucauggcacuuagauucuucugguuucccaggcagaaacucccagaaucucuaacucuggucauucuguuugucuucacuuuguaagguuuguaucucccaccaucauuccucucuguuccuauuguaaccaccuuugaccuggcccuugucuccuaaagcuugggcaguaacccuaucaaaccauuauuuaaaaugcacucagguuaacauuaauaaaaugcuuuuuugcccauccugaaauaucacugaagaaaaaauuucagugaagacugggaggaccuccauucucuauuuuagaguucaauacugccuugaaaagugugccagacucauagcuucuaaaugaccuuuggguucugccuugcuuuuugcuagccaaauaaagauaguuguauauuuucccucugagccucaguauuuuuuaaucuauuaauuaaaaaaaauuccauagguuauugggauacaggugguauuugguugcauggauauguuauuuagugguguuuugugagauuuuggugcauccaucaccugagcaguauacacugcacacuauuuguaguauuuuaucccucgccccccuucacugccuucccuccaaguccccaaaguccauugugucauucuuaugccuuugcauccucauagcuuagcucccacauaucagugggaacauacaguguuugguuuuccauucaugaguuacuucacuaagaauaauagucucgaaucucaucaauauauauguguauauauacauauacacacauguguguguauauguauauauacacacaaacguguguuuuuauguacauacacacauacguguauauauguauguauacacacauacguguauauauguacguauauacacacauguacauguguguguauauauguauauaugcauacacauacguguguguauauauauauacguguguuuguguguguguguguguguguguguguguauauauauauaugauucuuuuuaguucuuuaaggaauauccacacuguuuuccauagcagcuguacuaguuuacauuuccaccagcaguguagaaguguugccuguucacgacauccacaccaacaucuacuguuuuuauuuauuuuuggauuauggccauuuuugcaagagugaggagguauuaaauugugguuuugauuugcauuuccccaaucauuagagauguugagcauuuuuucauauguuuguuggccauuuguauaucuuuuuugaaaauugucuauuuauguccuuagcccacguuuuggugggauuguuugauuuuucuaccugauuuuuuugaguucauuguggauucuggauauuaguccuuugucagauguauauauugugcagauuuucucccacccugugguuugucuguuuacucugcugacugauucuuuugccaugcaaaagcucuuuaguuuaauuaggucccggcuauuuaucuuuguuuuuauugcauuugcuuuuggguucuuggucaugaaaucauugccuaagccaaugucucgaaggguuuuuucaauguuaucuucuagaacuuuuauagauucgggucuuagauuuaaguccuuaaucuaucuugaauugauuuguguguaaugugagagaugacauuccaguuucguucuccuacauguggcuugcuaauuaucccagcaccauuuguugaaaaugguguccuuuucccacuuuauguuuuuguuugcuuugucaaagaucaguuggcugcaaguauuugggguuauuucuggguuuuugauuucguuccauuggucuaugugccuauuuauauaccaguaccaugcuguuuuggugacuauggccuuauaguauaguuugaaaucagguagugugaugccuccagauuuguucuuuuugcauagucuuguuuugguuaugugggcucuuuuuugguuccacaugaauuuuagauuuuuuuuuuguaauucugugaagaaugauggugguauuuugaugugaauuguguugaauuucuagauugcuuuuggcaguauggucauuuucacaauauuguuucuacccauccaugagcaugggauguuuccauuuguuuguaucgucuaugauuucuuucagcacuguuguguaguuuuccuuguagagguuuuuugcguccaugguuagauauauuccuaaguauuuaauuauuuuuugcaacuguuguaaaagggguugaguuguugauuugauucuccacuuugucacuguugguguauaggagagcuacugaauucuguacuuuagucuuguaucuggaaacuucguugaguuauuuuaucaguucuaggagcuuucugagggagucuuuaggguuuccaagguaaaugaucauauggucagcaaauagugacaguuugacuuccucuuuaccaguuuggaugcccuuuauuucuuucucuugccugguugcucuggcgaggacuuccaguacuauguugaagaggaguggugagagugggcaugcuugucuuauuccaguccucagagggaaugcuuuuaacuuuuccccauucaguauuauguuggcuauggguuugucauagauggcuuucauuacauugagguaugucuguuguaugcugguuuuguugagaguuuuaaucauaaagggaugcuagacuuuguugaaugcuuuuucuucaucuaaugagaugaucaugugauuuuuguuuuaaauucuguuuaugggguauaucacauuuauugccuuguguauguuaaaccaucccugcgucccugguaugaaacccacuugaucaugguggauuaucuuuuugauauguuguugaauucaguuagcuaguauuguguuaggauuuuaguaucuauguucaucagggauauuagucuguaguuuucuguuuugguuauguccuuuccugguuuagguauuagggugaugcuggcuucauagaaugaauuaggguggcuucccucuuucucuaucuuguggaauagugccaaaaggauugguaccaauuguucuuugaaugucuucuagaaaucaguugugaauccaucugauccuggauuuuuuuuuuuuuuugguaauguuuuaauuaccauuucaguaucucugccuguuauuggucuguucaggauauauaauucuuccugauuuaagcuggggggguguauuuuuccaggaauuuauccaucucuucuagguuuucuacuuuauguguguaaugauguucauaguagccugaaaugaccuuuuguauuucaguggugucaguccuaaugucucccauuuuguuucuuaaugagguuauuuggauuuucugacuucuuuucuugguuaaucuugcuaauggucuaucaauuuuauuugucuuuucaaagaaccagcuuuuuguuuuauuuaucuuucguguguuuuuuuuuguuguuguuucaauuucauuuaguucugcucugaucuugguuauuuccuuucuucugcuggguuuggguuugguuuguucuuguuucucuaguuccuugaggcacaaccuuagaaugucaguuugugcucuuuuagucauuuccauauagguguuuaaggcuaugaacuuuccucuuagcaccaccuuugcuguguccuuuugauagguuguguuguuauugucauucaguucuaagaauuuuuuuaauuuccaucuugauuuuguauuugacccagugaucauucaggagcagguuauauaauuuccauguaucugcaugguuuugaagguuccuuuuugaguugauuuccaguuuuauuccauuuuggucugacagagugcuugauauaauuucaguuuucuuaaauuuauggaggcucauuuugagcccuaucauacggccuaucuuggagaaaguuccaugcacuguugaauaggauguguauucugcgguuguugguugaaauguucuguauauaucuguuaauuccauuuauuccacgguauagguuagaucuauuguuucuuuguugacuuugucucuugaugaccugucuagugcugucaguagaguauugaacuccaccacuauuauuguguugcugucuaucucugcugucaguagaauauugaaguucgccacuauuauuguguugcugucugucucacuucuuaggucuguuaguaauuguuuuauaaauuugggagcucugguauuauuugcauauauguuuaggauugugauauuuuccuguuggacaaggacuuguaugaugauauaaugucccucuuugucucuuuuaaguguuguugcuuuaaaguuuguuuugucugauauaagaauaguuaccucugcucacuuuugguguccauuugcaugaaaugccuuuuuccaucccuuuucuuuaagguuaugugaguccuuauguguugggugauuguccugaaggcagcagauaauuuguuggugaguuuuuauccuuucugcaguucuguauuucuuaaguggagcauuuaggccauuuacauucaauguuaguauugagaugugagguaccauugcauucauugugcuauuuguugccuguguaucuugcuuuuuuguuauuuuuaaauuuuguuuuuguuugauagguccugugugauuuaugcuuuaaagagguucuauuuuuauguguuuccagaauuuguuucaagauuuagagcuccuuuuagcaguucuuguaguggugguuugguaguggugaauucucucagcauuuguuugucugaagaagacuguaucuuuccuucauauaugaugcuuacuuucaguggauacaaaauuccuggcugauaguuguauauuuuuaggaggcugaauauagggcccaaauuucuaccagcuuguaggguuucugcugagaaauuugcuguuaaucugauggguuuuccuugguggguuaccuggugcuuuuacacuuucccuccccuccccuccccucuccucuccuccuguccccuguccuccucuccccuccccuccccuccccuucccuccucuuccuuuccuuuccagucucacagaucuuaagauucuuuccuuuguguuaacuuuagauaaccugaagacaaugugccuaggcaaugauuuuuuuugagaugaauuucccagguguucuuugugcuucuuguauuuggaugucuagaucucuaccaaggccagggaaguuuuucuguuauugccacaaauauguuuuccaaaauuuuagauuucucuucuuccucagaaacacugauuauucuuagguuucauuguuuaauauaaucccagacuucuuggagucuuuguucauauuuucuuauucuguuuuuucuuugucuuuguuggauuggguuaauuugaagaccuugucuuugagucgugaauuucuuucuucuauuuguucaauucuauugcugaacuuuccagagcauuuugcauuucuaaaaguuuguccauuguuuccugaaguuuuuauuguuuuuucuuuaugguaucuauuuccuugaauauuucucccuucacuucuuguaucauuuuuuagauuuccuugcauugggcuucaccuuucucuguugccucccugauucgcuuaauaacuaaucuccugaauucuuuuucagguaaaucagagauuuuaucuugguuuggauccauugcuggugagcuagugugauuuuugggggguguuaaagagccuuguuuuuucauauuaccagaguuguuuuuuugguucuuucucauuugcguaggcucugucagugggaaggucuagggcugaaggcuguuguucagauucuuuugucccaugggguguucccuugauguaguacucucccccuuuaccuauggauguggcuuccugugagccaagcagcagugauuuuuauaucucuucugagucuagccacccaccaagucuauccggcuuugggcugguacuggggguugucugcacagaguccugugaugugaaccaucuauuggucuaucagcuguagauaccagcaccuguuccgguggaggugucaagggaugaaauguucucugugacaguucuuagcuuuggugguuuaauguucuauuuuuguggugguuggccuccugccaggagguggugcuuuucagagagcaucagcuuugguaguauggagaggaaccaguaguacacggggcccuagaacucccaagaguauaugcccuuugucuucagcuaccaugguggguagggaaggcccaucagguggggguagagcuaagcaugucugagcucagacucuccuuggauaggucuugcuguggcugcugugugggugggggugagguucccagauccauggaguuguguaccuaggaggauuauggcugcuucugcugagucaugcagguggucagggaagugggucaaagcuggcagucacaggccucacccagcucccaugcaauccaaagggccagucucacucccacugugcucccauaacagucccaagucuguuuccaggcaaugggugaguagggcuugagaaccugccccagguuacccaccucccagcugugaaauaaaagggcuuugguucuucccacuccuuuagagucuccacaccagauucaugcccuaccccaaguucuggccaggaugcuucucuucugguucaaauuguuacaaaguucagcuggagacuuccuuuuccccguggcauuuuccccugugccucuggcgacccuucugaagguucccugugguuccaggccugcuuggggacccagcaaacucccggggcuuuucccgcugcuuccucuaccccuguauuuugcucagcucucuaaauugacucagcuccagguaaagucagaaacuucuccugcaaauuagacuuuccccaguguguuuccccaguguguuaaguguuuccccaguguggguguguguuaaggaauggaggaucucccuuucccacuucugcuguuggagugcucaaaguauuuggagugucuccuggguccugcaggagcaguccacuuccuaagagugucuguagguccucucgagaucccugguuuguucuugcagucguccuggagcuaaaaugcacgaugcaaaccuccucacacugcucuguccaucugaguuggaauugcaaucuaguccugccucccgucugccaugaugaucccccagcucuacuucuuuacugagaucuugagcaagaucucagaucugucuguuccuuccucaucaugugaucuucuucuuuaauguauuuauucauuuauuuauuugagacagagucuugcucuguugcccaggcuggagugcaguggcacaaucuugguuuacagcaaacucagccuccuggguucaagcaauucuuguaccucagucucccaaguagauggaauuacaggugcaugcaaccacaccuagcucaauuuuguauuuuuaguagaauugagguuucaucuuguuggcuaggcuggucuugaacuccugaccucaugugaucuacccaucuaggccucugaaagggccgguauuccaggcgggagccacugcaccugcccaaauuuauuaauuuuugauaacaaucccuagcuuccuccuagggaugugauggugaucuguugagcuaaucgauguaaaauccuuuauaaacuaugaaaccuuuuacucagacaggagaguauucccaguauucuguagauuuucaccauuuuaucauucaacaaauauuuguuuaaugccuacugugugccaggcacuauuguaagcacugaugaugaaguagcaaacacaauacguaccauggccucauagcauuuacauucuaacuggggaagaaaaagcaauaaaguacauaagauuuaugauaugucauaaggucauaugugcuauggaaaagaauaaaacuggaaacggggauaggaauucuggaaagaaggugaaaauuugagagaguggucagggaagccugacuaagaagacuguauaugaacaaagaacugaagaagaugagggaaguagccaugcagguaucuggggaagaacauuccugcuugagggaacagcagaugugaaggccuuaagaugaaggcauuucugguuaguuugaaguucaacaaggaggccagcauggguggagugaagacaauaaggaaaagaguaguagaacuuaaggucaauaaauaaugggggaaauugagguaggcguaucaucuaaggucucuauuggccauuauaagaacuuaauuuuuuaaaauaugagcucuuuauuauaugccauacaucacuguguauauuuuauguuuuuacauacccauucauuuuuuaaguuauauccaaaacuguguaggacuuaugugauauuaugagugaaagagggagccaucaauggcuuuugaggcuggaaaugacaugaucuaacauguuuuauccccuuuaucuuuauuuucuauucucccuagaaaaaaauggauagaccuuggguuucucccucaacagauucucucugaauaugggggagagauacagaaaaaccuuuuuuucugacugcauuuuauuuucaggugaaacagacaaggucagaacuaaaagaaaagagcccuuaaaacugugauuuucaacauugacugcacaugagaaucacuuggugaacuguaaaauguagcgugcucaugccacauuuuugacuaacuacaacagaaucuuaggggagggacccaggugucacuauuuuuuggcacucccaaggugcaaccaagacugagaaccacuggucuaagagauuagccaaaccaacucccucgugguaugaauggagaacuugauuccagcauugggaagggauauucuccugauggcagagcugggacuaggaccauucacuaugcugagcuaaaacaggaaaugcaaacuuuacaaauaguggggcagaaggaagauaugauguuugauaguuuggaaggagguuauaaacaagauaaaccuuggauagaaguggccuugggucaguucagaaaagggaaaggcugagugccaacaccaaaagguaaagcaacauuugaauuacaggccaggcaucuggaaaugauggcacuguacaguuuagaagcuugauuuucaagaaagcaguguucucaaggcuacguugagcaacuucuuugauucugucuugugcauguggguggauagaugggcucgcaguagaggaaugggcaaggcauggagaccaucugcugucuucuucaucguuuuuaaucccacaccuccugcacuguccaggcaaagcaaauauccugaaguacugaguucuuaauuuagacuuguccuucuuuccugccuacccauacuacauagagagagcauguuucaccccacaggcaugugugcaaguugagaagagcagcagccacaagcugcagcaaggagcagcugcacccccagcagccuggguaccucacauccagcagaaacuuggccaacaucaauuauucagggcaugaugagcuaauuuggggauuacuauugaugucagcuguauuguuucuccucuucccugucugcuugcauucuuaaucgucuacauuauuuuuugaggaaucaggacagggagaugggugggaagagcagccacaugacagacaggcaaaauaagggaauaauucuagucauauugccacuuguuggcccuuguaaacacaaucaagguauauacaacacauacuuggauaaguuugggugagaaguuggaugaaucaaauuauauuuggaggccuguguaaaaauauucauagcagcuuuaacauuuuuuggggggcuaacuuaagcaauauccuauuggaauaauaaauucaaaguauuaaauaaagcuaaagaaccaucuuuuaaaaugagauauaauucacauacuauaagauuuaccuuuuuaaaguguauaauucacuaguuuuagcauauucacaaagucacacgaccgucaccacugucuaauuccagggcauuuucaugacccuagaaagaaacauaccuauucagcagucacuucccauuucccuuucuccccaggcccugauauccacuaaagcuaguuuaugauugauugccuauucuggacauuucauguaaauagaaucauacaacauuuguccuuuugugucuagcuucuuuuauuuagcauaauguuuucaacguucauucauguuauugcacauguuaagcacaucauucuuuucucugacugaauaauuuucauuguauggauaaaccacauuuuguuuaccauuuaucaguugaugaacauguggauuuuccccacuuuuuggcuauuauaaauaaugcugcuaggaacauuuguuuacagguuuuuguaugaacacauguuuucaauucuuuuggguauuuacacuuaggagugaaauugcugggucauguuguaacaugauguuuaacauuuugaggaacugcaaaauuaauuuccaaaggggcugcaucauuuuguauucucgccagcaauacacaaggguuccaguuucuccacauccuucucccccaggcuggagugcaauggcacgaucucggcucacugcaaccucugccucccggguucaagcaauucuccugccucagccucccaaguagcugggauuacaggugccugccaccauccccggcuaauuuuuguauuuuuaguagauucaggguuucaccauauuggccaggcuagucuugaacucuugaccucaggugauccaccugccucggccucccaaagugcugggauuacaggcgugagccaccgugccuggccggcuauuuuuuuuuuuuuuuuuuuuuuuugguaguggauauaaagugcuguuuuauugugguuuucauuuucauucccuuuguugcugauaacaccgaccaucuuuucauguguuuaugggccauuuguaagucuuagagugauaucuauucaaauucucuacucauuuuuaaauuaucuaucuuuuuuugaguugcaagaguuuucuauauauuuagauacaagucucuuaucagauaugugauaugaaaauuuuuguguccuauuauguggauugucuuuucacuuucuugaugguguccuuugaagcacaaacauuuuuaauuuuuaaauuuuguugacaugucauuguucuguuuuucucucuuguugcuugugcuuuuguuguuauaucuaagcaacuacuuccuaauccagugucacaaaaauuuacaccuauauuuucuuauaagaaaaacauuaauuacagaauuauuauguuuucuuguaagaaaacuuuuauaagaguuuuauaguuuuaacucuuacauuuggggauuuagucuauugugaguuaauuuuguauaugauaugagguagggguccgauuugauucuuuugcauguggauauccaguuuccccaacacccuucuuugaaaagauuuuuuuucucauugaauuuucuuggcauucuuuaaaaaauccauugaccauaguauagcaacucaauuuauaauggccucaaauuaaaagcaguccaauguuugccaagaaaaauauauaaauugugguauauccauacaauaggauacuacacaacaauaguaauuaacaaauguugcuacacaaaacauaauggauaacuaucacagacauuauaguuaucaagagaaaccagaaacagaagagcgcaucuuguaugauucaaauuuaugugaauuucaaggacagguauaacuaauuguagugauagaagccagugcuguaauuaucuggggaggagucgauauugacugggaaggggcgugagggagccugcugggguaauagaaaaguucuguguauuuauuugggugguguuuacaugggcauguacacaguaaaaauuuauuaauuuauuuaaucuuuaugcuccuuacuauguauauguuguacugcaaucagaaacagacaaaaaaucccagcauguuacccacaugaauuuuuagagcacuuccacauuaccucaucuguguaacuucugaguuacacagaucagauauucucugggcaaguugggaaguuggaggaaguauuucaggguguagcugacaaacaguacaacugagugggugaugcgcuuuagcagaaucagaaccucaucauguguuauacuccaugggauugagacaagaggcaucugccacuucccuuccucuccccaacccucaguaauguaaagagaacacaaccccaugucagaguuggggugaaaaaaauguucuugagcagccauaaccuuagguuguggaggugagagggacuguucuguggaaaaucaugugcuauuucauaaaguccauaauaacauccucacuuauuugcaaaucugauuuuauuucuuuuucacuuccauuucaaaggcaauugucucggaaaaguuuccaaacguuuguugaccaaguuaauccuauacagaaaugccuugaugaaaaaaauccagcaaacacuuagaacaauguuucuuuuagccaagguggcuuaggcacugaggguaucuuggagaaucuuuuccuuaagcaucaggucacuggugguugcgauuaaugaggaggaaacugcuauaguggcauccaucuuaaacauggccuucaugcuccagcugaaauggucaaugaagaagcuugggugccuuuccuuuuucuuccccacacaucccaaaaaugacaaaugugcacuccuuuuacuauaaaccucacucuucugaagaggaaagaagaaagggaaccugcuaauuaccaaacgucucauauguaucaagcccuauacuuggucccuuaauauguauuauugcauuuaauuuucuaaauuacugugcaguauauuauuuaaacauccauuuugcagaugaaaaaacugaugcugacaaagguaaaacuauuuguuugaggaugcagaauuaaaauuaaaacucaagucuacaugucccuaacuaagagcuuugcucuuuuuuugauggaugugagguuacuacuauuguuuggaaagucauuaucuuaaagagaaaugaucuauguugcuagauucauaugcauaguuaaccauaguccagggaauguagcauguugauaagcuaacaaauaguaagcacuguugagguacacacucugugccaggugcagggcuaggcacugggcaugcaguggucucuacucuugggaacuuuauaggucuguauauauugccaacuuagccagaaguuuagaggauucagccacauccuuugugauacuuuggaagagugucuagcugcaguauggaauaccucagaguaacuauaauuuucugaaaacauaauuauucuuucuuauuuuuucuuuuaaaaggcgguuacauaugcuacaggaaacuguugauuacagggaaaaauucauauaaggucugacuuucucccuagguaaugacauuuaacccuuauuagguaguuuuacacauacgcccugaccucuucaaaagaguccagaaucuauaauuuuguucucuuuaauaaagucaauuuguuaagcgucgaaugaaagauaauuuaauuuguaugcuuugaauaaauaguaugagaaaaaaagagggaaggcugggcaaggugccucacgccuuuaaucccagcacuuugggaggccgaggcggguggaucaccugaggucaggaguucgagaccagccugaccaauaugaugaaacccugucuauacuaaaaauacaaaaauuugcugggcaugguggcaugcuccuguaaucccagcuacucgggaggcugaggcaggaaaaucacuugaacccaggaggcagagguugcagugagccaagacuguaccauugcacugcaacaagagcaaaacuccaucaaggaaggaaggaaggagagagagagagaaagaaaggaggaaaggaaggaaggaaagaaggaaggaaggaagggagggagggagggaaaaaagaggggagagaaagucccucugcucaauuuggcaccaagccugccuugccuagacagagguuucaaagccaugguuagagagacauguugggguuuaggacacaugauguuuauuagggggguggagcucuagaaaccaaaugaaauaggaugucucagacccucaaaugccagcagcaguugucauggagauuuuaaacgccuauguugggaacuuagcucaaaaagagggcuacuucuugguuccugccaauguuuuucuguuuugugggcaaaaagggauaugagaaaguuguccagagcaguuuccuggcccuguuacuguggugcuuaacuuccuggucaugaaggcuaugagaauacugaaguuuucuguucucaaggagaagagugcauggcaaggggagggaagcaugccuacugaggccaacaccaugggccagcaaucaaaucagcacagaagacaguauguuuaucuuaugcaagcauggaucuuguagcccacuuuccuuugaaugaaggaaugggaaagaauggcccaguugaugaugaaaaaaaggugcacuuauggaaugccauuuagaaugacuuaaccugucgcuuuuggggaacuuugaguggaggagugguggccucucaagguacacauguacacucucgucucuucugacuaagaguacacauuuaggacuuuggcacuuuuagaaaccacuugaaauucacccuaguaugaagucaugaguaaguaaagaaccucaugcuaccuuucucuuugaguaggauaagccccauuuaugaauuacuuuagccccuucauuaaaauuccucuuuguagaagacaaccuuucugcauacuuaacucugucuuauuuuguauagcucuuuagaaugguuugauggaccuuagcuccuuuaacccucccaagagcuauauacaauaggugaagaacauucuaucccuuuuucuuagauuaaguaaccgaggccagaaaagauaaagugauccaucccagauuguagauugaaaggguaagagccaggcuuggugaacagccaucccacuucaaugcuagcucuacugcuauaugcaucuguauuccaagaacuauuaucugaguaauguuucccuaucugugcaccuuugugcaccaaaauaugucuacauucuggguuauucuccccucccauucugccuaagacagaagcuauggcagguauugguccucagagguacugaggccacuguuggcaaagagaaacaauguuucagcuuuuucaguuauaaaauaaagaugacaaucucuauaaugcuuaccucacauggauguuguguagaucaaauaauaauagaugugaaaguacuuucuaaauuguuaugaucuguucacacaugagggauugugauuauucuuuacccccugggcagaagccaacuccuugucuuauuacucucuuuacaaauucagcuccugguauagccacugacugugaauuugagcaaauugcuuggucucuuugccucaguuucuucaucuguaaaauguugcuaacaauaauucuuaauaugauugucuugagaauggaaugaguuacuacaugcaaagcauuuacaagaacucauggcacauggucagagcuacauaagcauuaacucuuuuguguuggcuuccucgucccuacuaucucagaucuagagaauagauuaaggggacccagaagccaaguggcauggaagccacuacuuauagucccuucccacuagcuugcuaguucuuguguucucuacccacagccuucccaccauggauugccaagaaaaugaguacugggaccaauggggacggugugucaccugccaacggugugguccuggacaggagcuauccaagguaaguuauccuauucaguacacuuauuucuguugcaucuuaggaaccagcccggcaacugaaagaggccaagauuaggggagucagcccuacuuaugacugauccaguucagcggguaaaaccugggauccacagaguaugcaauagcagucaugauuccagcaugaagucagccuagcaggaucaaggucaagggaaguuuccaugagauaacagaguauuucaagaauagauguguaaugcagagacccaugaggacuguucagcauuaggguaaucugucaucuaaagcaaggcccaaccacaugguguucaagagccagauaucaggucuuaggaaugagaaagagagaagagccaagaagaccucuguucuagagggucugcgcuacugaggaagcugugcaauggagaauauagggauagggaaccacggagggucuaaaaucccaauuaaagauaaggaucagaauaaaaugaccagcaaggcagagacuuuauguaacuuacuuguuucaagccuggaucugcuuaauuguucuuuccucaggucccuuguaggucccugaacuugggggugguauuaaauuuuggcugcagcuggggcuacagaggccagaagcaagcagcuagcagaugguuucugcauauucacacucuauuuuaugcaauuuuuguuuauucagcaguugcuuauugaacacuugcagaguggcaggcaugguuguagacaccauggauauggcagaacaaacaaaaauauuugccuucauggaccuuaccuucuauuauuagugaaaaaauaauaauugagacacauacagagauaaaugaagaaucuggauaugaagauaugagaagaaucaaauuagggugacuggguggcuacuucagauuaugaaacaaggaaaggucucccuaaggagacagccucuggggagaggauacuagugcagagucccaaggugaaaaugaacuaggcauuuugaaggaaaaggaggaagguagugcaauggguguauggugaaugagagggaggguaguacacaaagaggucagagagagaaguauagaccagaccagauagcagcuugaggucuaugagaaauuuucaucuuucucuaagugcauuaggagcucuuuggaggguuuuggguuggaaaguuauaggaaucuguggcuggaaaacaacauaauaauuaucuagcccacuuuauuccuaccuuuguauuuuaaaaaaugaagagaauaaggcgcagggauaucaagagauacaagcacuaauucuaaguuuuuacacauggcauuaugucccacagugggguacccacaugguugauaaaggaucccaguaccaaggaaagaucgccagagguaaggucaugcuggacauuaaaauagauauuaaagcuuauauauguguaauacauauaagcuuuagagccagauacacaugggcaugagucccaucuuugcucugggcaaauuauuucaccucagaaucaauuaggauguaguaaguugaaaguaacauaaaauuuaaccaugacaugaaccauaaguauauuuauuuauguaaugaagucuggagacaggcaaccuuuuugcuuguugggcagaucagcaauguuaucaaggacucagccucuuuucauccuucauauuggacaucuugcuguuuuguucucauuguggccucaugauugcaaaacucaaagcaucauaucuccauacaauagucaaagucaggaaucaggggcaaggucaaaauagcuugccuuuuguagggaagaagucuuuucccagaagcuguccaacagauuuuuccuuauaucuuaugguccagaacugggugauguagcuaucuuuagcuggaauagagacugggaaauaaguaucuggccaaugagaaugggauugugugauuaagaccaaucaagaauccguucuggaggcuagucuucaugccaccuagaaugaaaucaguguuuuuauaguaaggaagaagaggggcaauuguuugaauaagcagcuagaagcaucugauagccuuuuuuaaaguaacuuuuauuuacuuuuaaauuuuacucaugaauuauaaacaucacuguaaauaaaucauugcagaaaauuaacaccauuuccucaggacauuuuucuugauguauaauugccaagcuaaauaaugcguacgauuuuaagacucuugaaauauaucagcagauaacacuucugaauuuuguuuauacuaauuucuauuaccauuacauuuauuuucaacagugcauagaauuccuguuguggcccucuguucggggucccugacuucccacaacaaauucccaugucccagaagccuaaacgcaaaugaauaauagauauuuucaugaucuauuaauuuuaugccuuccuuuuaacaguaauuacuaauuuaugaggacuuuaugagaauuuugguuuuacuuuuuaucuauuugauaggggaaauguaccaacuuuacuguguuuauuugcccauuugccuuuccaauuuugugaucuauuucugauuguuucucuuucuauucuuucuauucauuauguauuguucuuugucuacucacauaaggaaccuaaguagacagacauauaguagauaacagaguauuuuaaaaaucguuuaaaauguaaguauauuuguauuuaaaaaccagaaaugcuuuuaaauuuuguuucauuuuaguaucaucuguugauuuguaaauauauuuucccuuugauguauuaauuugaugacauguauuaauaaauuccuaaaauuuaaauauccugcauucccaguauaaaccauucuugauuauaguuuuaagguaaauacccuuuuauguuguauaaguuaguauuuuaacuaaaacaaauaauuauuauuguaacacuaucagcaucaaaauuuuggaucagcauugugcuaccauggcaaaaucaagaauaucaauguuuucuggcuauaaaagugguuaauagcaaaagaaauuuugcaccuuaaugauuugaaagaacuuccuuugccuccuaauuaugaaggagaauucucaauaaauuuuuaaugauaauuugcuccuuaauuuauuaaaaauuauucauuuauuuaauuuuuauugaguacaauuugauagucuuugguuuuauuucacuaugccaaucccugucuuuuaauuggcuuacuuagaacauuuauguuuaaauaaucuuugauauuuuaagauuuaaaccuaacauuuuauucuuuuuguguuuguuuucucuguuucuuuugucccucuauuugucuuuucuugccuuccuguggguuccaugaacauuuuauuuaggauuccaucaugauuuauuuguaguguuuuugagugugucucuuuguaucauuuuuuuagaggugguucugaguauuacaugaaaaacuaacacguuacuuuuucaaugucagcugguaucaacauuuugccauuucaagugaaguauugaaauaucuguuccauuuagauuccuuuacuuuccccacuuuuaaauaucauugucacgaauaucagauauaauuuuuguuaaauuuguuuuagucaucuacuaugauuuauaaaauguaugaagagaaagauaguacauuuuauacaaccauauuuuuucuuucccaguguuccuuccuuccugaugcuccaagauuucuucuuuuaucacuuccacucuuucuuaaaucauuucauuuguguuuuaugaacucucuuuagaauuauuuaaggguaggccuacuagcaacucauucuguuaguuuuccuuugccugagaauguuuuuaugucccuucauuucuggggauacuuucacuggauauaaauuugcaguugacaguuuuuuuauuucaguacuugaaaaauguaauacuuccuucuuggcuuccauggcuucugacagaaacccacugucguaucauuugaauggguguuuuucuauagguaaugccauuuauucuuggcuauuuucaauauauuuuuuuuaguuuucagaaguuuuauuaugauguguauuggugugcauuacuuuggauuuuuuucuguuugggaucuguucauccucuuuaacuuguaggucuuuuaccaaauuugugaaguuuucuuccaauuuguuugaaaauauuuuuagauaaacauuuaaaaaauuuucuuuucauaagauucugacaauaugauuuuucuauauuuuguuauagucucauagguucuugaggcuuuguucauuuuauuuugucauuuucucccuguuguucauauugcauaaauucuguuguucuguccucaaguucacugauucuaucaucugucucuucucuacuacuaagcccauccagugaauuuuuaaaauuucugucauuuuauuuuuaauaauuaccaucuguuuauuuaaaaaaaacuucuguuucuuugaugagauuuucuauuuuuaagagaauuuuaaauuguuuuuuaaaacauuuuuauuaugggugcuuuagaauccuuguucaaucauuccaacaucugcuuuaucuaagaguugcugucaguuaauugacuuuucucauucauguugugauuuuccuuauucuuauuaucaugggugguuuuucguuguguucuggacauuuugucaauuaugucaggagacucaggguccuauuuaaacuuuuacuuuagcaggcagucaucuguuuauguuuagcauacagguuuuggccuacguuugugagcugcaguucuaaaggcuauuuaauuuccagaaccuuuguagugugauuuuuggucugcgggguuuaucuugugcugccucagguauagacgauuuccugggccaggucacuugguccauuuaggucggcauaaagaagugucugaguuguagagucaaagaacauuucccaugcucgaccacuuguuauuaguaggauaccacuugccaguauaccccagccaccuguuccuaugugggggaaaauaaucucagacccacaggacaaagaagcauuugagcugguuacuuaugguggaaucucaagugcccccugcagccuauugucucuaguuguguguggggaaucgcaggcccauggggaagaggcuucucaggccaacaauuugugccucaauuuugcuuauuugugaaacauggauuauauugcacccuuauaagguuuuaugaugaauaaacaaguauauaaauucaugaguguguggauuuuugucugauugauucaauuauuuagucacaauauucagaauagcauccucaugcauuguaguugcuucaaaaauguuuucugaguuaaccaauaaaaugaaagggagugcuaaccaauuaaucaaucaaucaaucacucaacuuauugguuaacuuucaauaaaugcuagcuugcuuuugucauucccuucucuagcaagugaguaagugaggagucaggcacauaucuucugauuccagugcuauagauagaauaaaaacuugcuuuccagaagaacaauaccuaauguucaucuguucauugaaggauuacuauguucuaggcauggugacaagcacuacacacaacccacacacagagcuauauauguaucuguguguguguguguguguguguguguguguguguguguguguuuguguaucugguuaagagacauccuuuaucuaaauaagagcuguuuguguuucuuuuucugugaauauauguuuaguuucucauaaggugguugucguuaauuuauacuaguucuguguuaucggaauauaaaucuuuagucugugauaugguguacaucuuuuuacuaguucauuauuugucuucuaauuuugcuuaugaaucuuuuacccugaaacuuuuuaaaauuuuuauguaauuauaucuaucuuuccuuuacugcuucuggacuucguguugcaguuagagaaaauuucuccacucccagauuaaagaggaauuuauuuauauuuuguuuugguacuuuuugguuuuaauuuuuaucuauaaauuucugaucuauuuugguguauagugugaggaauguaucaaauuuuaucauuuuucacauugucauucgguuauccaacauaaccuauuuaaaaagccagcuauucuccauugcuuugggauauuccuuuuguucauuuggucagcucauguaaucuuaacaaaucuauaaguuggauagcauuauuuccaauuggauugacaagaaaauucaggcccaaugacuugcccaaggucacaucgcuggucaguaguaaaagugggaguuaaagauaggucuucauuaccuuggaucagggauuuucaucacuacauuauauuuccuaauaauuugacccccagcucacuguuuuaagcagauauggaagcuaucaccauuccaguggugcacauaagguagcagagauuccaagaaacccuuuaacuuuucaagaaacuuagagcaugaguaaaaugacuacugcccaugucagaucccauugguagaugggaucauugugagugaggcugcaaggcauugaguaaagccugagugggcaaacauggggcagaauggaaggaguauuucgagccugccugaugcucacuuuuuccaacuccugggaaaguauaacuuaaauguuaguucagguaauauuaacugcuguaacaaauacuaaaguuuggugacauaagagguuaaggguuuauuccugaaugugacuccaauccauguuggggaguaggaagauucuucucagccauucaggaagccaggcuuaugggagcucuguguuuuuuaagcagccuuauuaaaauacaguucacauaccagucaauucacccauuuagguuuacaauucaugguuuuugguauacugcauuaugauuuuuaagauugugguaaaauauguaaucucaaauuugcuguauuagacauuguaaguguauaauucagcagcauuaaucacauucacaauguuaugcaaccgucaccccuuuauuucuaagacuuuuuauuaccccaaauacagucucuguaugccuuaagcaauaacucccaauuucccccuccccaaagugccugauagccucuacucucugucucuacaaauuuugcuauucuagauauuucauguaaguggaaucauauuuuuucaugcagucaccuuuaccagagauauuuacucuuugcauggcuuuggguuacucuccauugucuguucauuucagccugaaggacucucuucuuguagucaggucaaaugauaucaaucagcuguuguuugucuagggauguuuuaauuauuccuuuauuuuugaagaacuuuuuucuguauauagaguucuugguuaacaguuuauuuguuuaggcacuuauaugucaucucacugacuuuaagucucugcacuuugugaugagaaauaugcuuugaaucuuaucgagaauaccuuuacuugacaaguaauuucacucuugauuuucaauauuuucucuuuguuuucagcuauaaacauuuuuugauaguguaucucagcauaggucucuuuauguuuacucugcuuggaguuucuugagcaucuuggauggguuaauuuaugucuuucaucagauuugagaaguuuuaagccauuauuucuucaaauauucauucucgucccccaucucccuguuuuuucugugaaucccauaaugcauauauuggucaccugcaugauguuccacaaguuccuuauguucuguuuacuuucuucuccucagacuugauaauuuaaauuguccuacauucagguuugcucauucuuucuuuuaccuacucaaauucucuagugaaguuuucauuucauuuaucuuacuuuuuagcuccaguauucauguuugguuccauuuuacaauuuuucuuaaccaauauucucacuuuguuuauacauuuguuuccugauuucuuuuaguucuuuguccaugugugucuuugagcaaauuuaagacaguucuuuuagucuuugucuacuaagugcaaugucugggcuuccucaagaauagucucaauucuuucuuuuucuuguuccuuugaaugggccacacuugccuguuucuuuuuacacugugugauuuauuuuuuuguuguuaaaaacugggcaguuuuguauuguaaugaaguaacucugguagucagauuuccccucuuccuguuuuacuuuugguuuugguuuuguuuguuuguuuucuagauuuguguuguugaaggcuauaguaguccaucuguuguuguuauuauuaucauuauuguuauuauuauuauuuuguuugggacuggguauugcucugucaccccaacuggaguguagugucaugguuauugcugacuucagccuccacuucccgggcucuagcgauccucccaucucagccaccugaguagcugggaccacaggugcaugccaccauucccaacuaauuuuuguauuuuuggcaacaaggcuuugccguguugccuaggcuagcacuccauuuguuuagguguuuuuccaaacuauuuuuguagagacuauuuuuugucauguaucgccauugaaaccuauguuaauuuagcucauguucagcuaauguuuggacagcaauuucauugaaugcuaaaaguuaaaaaaugacaacaacaaccaaaagaaaaaauagucacacauuacucucacauuuuuagauuggcucugugcuggggaacuacuuaaacaguuagccagaugugcacuuagcuuagggaucagccugacauguaagcuuuaggucuccacuaguauuuucugagcaugugucuuguaugcacacaccuuucuaaauuccuccauguggauacuuuugaauguacuuauuucuaaaggaaccucccccagcuuuugcucccagauucagacagucuguuuuaugucuuaauccauaaucauugcccuagguauugugguuuguuaguuugccuugcaacauuuugaaacagugcccaucacuuuuccaaucugcauucucaaucgaguggaacauacauaaauaccuuguaucaguccuucaaauagcccucaaauagguuaggacagacauacacaguaauuugucaauaaguuuugcuuagcucacucuggaaucagguacugaggucucacacuaggaauacaggcugaggcuacuuuaagacuuccacuacuuuaggacugccacugcucuggggugagggauguaacaaguacaaguaaaaauagcagaaaacuuuccuauuauuuucaagugaccuuuuucuugauuuaacauuuacaugguugauguaagccuuugaauguuuuccagaguucugacaacauugauuaugacaguuccugcuuguuuuucuauguuucuguaggggcauaagagcuugaagcugccuacuccuccauuuuaucuggcuuccgcuaucauucuuaauauauuuauuccaagguuuccaggggugucagcaugcacuggaaaaugaauguaugaagaaaauuuaaguaucacacaggacauguuuuugagucaagccugggaauggcaaacaauauuaguauccauauuucauuggcuagaaaugaugcacaugcccccacuucauugcagugggguuaaagaauuuuggcuaaugguguucccaggagaaauaaagaauagguuaagugaacaaccagccagcuucugcuacaacuagcauacaauuaauaugcuuucacaacuagaauuguuucuuugagaaagagcugugacugguaucaggcaggagccuuguuccuguugaaguuaggcugucagaucuaagaaucucuagagagcauuuauuucaauuuccucaguguugggacuucugaugcccagaaacugggggucggggggaaggaauauggccaaaguuaguaccagagcugagacaagagccagcuagaguguuugccucucaucuauaccauuggcauucaaacauuuuuuaccaugaccuagaguaagaaauaacuuuuuaucacaacccaauauauacuuucaugcauuuuaucuguaaaacuuuuauaaaacaguacuuauguggguagugcuuaugacuauuugucaaauauuucagcuccccacauucugucacauuguagaauugcauuuucuuguaccuguuguaguuauuaaugaucaugugauguguauggccaaggacaugugaguaaagcaauaugggucauuucuuggggaaaacuuuaagagcuuguacgcaguucacaauguuucaaucauaaaagcagaaaaauaaagcuucuguaaccccggguaccccauugaggaugauguacagcagaguccucaggaacccccugguaggcaaauaugaugagugagaaauaaacuuuuauucuuuuaagacacugagauuuaggguuugacuuuugccauacugcagcauagccuaugcugacugauacaaauacuuagcuuuacuucauuccauguacucuuauauuugauacuauuauucuauuucauucuauuuuaucuuucaaugcuggcuggaagcuagugaauugguuuuaugacuuaguaaugggguugcaaguugcaaaauacuacccuguacaguccacuugucccacaggugaucccaucuccaagcuccuauaaagcaauauuaacaacccccaucugucuacaggauugugguuauggagaggguggagaugccuacugcacagccugcccuccucgcagguacaaaagcagcuggggccaccacagaugucagaguugcaucaccugugcugucaucaaucguguucagaaggucaacugcacagcuaccucuaaugcugucuguggggacuguuugcccaggugagcuugcuuuaugagaccaagcuugucugggcuuuucuagcuguuggagguuucucccauccucaccucucagaacuuagucgaaauauucuucuuauaaacauaauauucaguuuaagcucccagaagagagaaguggugucuucccaagauaccucuauaaagugcuuagcacauugucagucacagaugaguacuugaccgcuuuuccaucaucacucucagcugaagaccaaaguucaagguaaaucucacuguagacuuaaaagaaguuaugauguacuugguaucaaagcagugcaccccucucuuguggaauuaggucuccuuuuggcuacauggugucaugaaugggggaagaaguagagugucugggucucugagucagaaaaagacacagaggcagauaacucagaaagaggggugggcacuuacuuucagguuggcaagauucuuaggagcugcuuucccaggaagaacugguccaagugcauugcuuguuugaucacccugccauuccuaauugcucugaacacagguucuaccgaaagacacgcauuggaggccugcaggaccaagagugcaucccgugcacgaagcagacccccaccucugagguucaauguguguacccaguucucuucuucccuuucuccucaucccauuggguggcagcaagauaggguaguaaagacuacccauauccccucauaccuuuucauguagaguagaguggcaagggaaucagauuagaagucugguuuuacaacauauuaucuuugcaacucuaugcaaaucauucaaucucauugaaccucauuuccuacuucugaaaaaagggugagucaugauaaucauuuuucuucauaccuugugugauggguaucuaggucuaaugagaaaauggauguuaggaagcacuucacaaauuauaauauuuguaaaccuaugagauauuauuauuauaugaaguauauaggagccccuagggcugaggacuuguaagaggcugaaugaagaacuaggguccaaucuaugccuauaccacuauccauuuaucuaaucgucuaucuuuuuugucuaccaucuauuuacuuacuuccuauuuuaaaauuauugacauauuuuuuaaaucaugaaaguuuucaaacauguagaaauauuuuuaagugcagaaaaauauaaaauuaaaaugcaaucacccagcaucuauccaaaguuaauaaaucauagcauuuugcauauuugcuucagauguuuuaaaagaauaaagauuccacagauauaauggaauucucuucuagauucucucagaguccuauuaccucccuaccuccucagauacaaccacuauccugaaauuguauguauucuguugguaggcuaugcuaaaguaacaaacaaacugcaaaaucucagugacuuuauacaauaaaaguuuauuuuuuuuuuacuaugcaaaggccuuccuacaucauuugacugugcauucuagaccauaugucuuccaggucaaugacacaggggaagagauggaggagacauacugguucuuaacugccucagucuggaagugacacauguuauuucaacucacaguucauuggccagaaguacucugauggccuuacugcaaggguguaagggaaauacaugggaguauguggauaacuggugagcacuauaccucugccauacucuccacuaauguuuuaauacuuggguucuuuugugauaugugugcauauucauaaccaauauaugcuauuguuauguauuguauaauguuuuauagaaaugauaucaagcuauauguucuguuucuccaacuuccuuuuucccccucuagauuauuuauauugauccauaaaggccuuuaagugcuguauaauaauguaagauuuuaggauuauaucaugauuuguuuaucuugugcucuacugaugaauuuuuuagcuuguuuccauugaucuggauuauauaauuagauguggcacagaaagaucacaggauaugugcaucuucgauuaauuguacuaauuucuacauaccagcacuauauacaaauuauuuugccuuguucuuuauaauuuugccugcucuagaaagaaguaaaaccagcauagccacccuaauuggggaaggcccuagggagaagggugacagccugaggaaguccagguccagggucagggugacuguuuacugcccaugcuaacugaccucccccauuuuuuugucucacaggugccuuccaguugagcuuaguggaggcagauacacccacagugcccccucaggaggccacacuuguugcacuggugagcagccugcuagugguguuuacccuggccuuccuggggcucuucuuccucuacugcaagcaguucuucaacagacauugccagcgugguaaggguggcuguuucauguuucacaugaaucaggaacaaggcucuuauuggcagaagagagggauguucugggguugagagacaaugggccuuuucuaccaugcuugaaaaccccaugaauagucuucuguuggccuggggaacuaucuggggcugcaauggaaagcaugggacuuaagagauuacugaagccaacccugagaguuuagaagaccugguucauuauguuucaggggauuuuaaaggaauguggcacggugggaaaccccucaggaaaggaaucgggagaccuagguucuaugucuaccucuaaaucaccguguaaccuuagacaagucaucuagccucuucagaccucuuucuuccuaaucuuuaagauaagagauaggauuggauuuguugauuucuggguucuuuuccaauucuuuauaucuauacuaguagguauaaauucuagagcaugucaugaauugaggaaggcuuggcuauaucugagauacgacuguaauaaaagugguugaggucuaaggccacugcuaucaguauaauaacuucacaaauggggauaacugaaagcccuauguccagaguaguuggcaaaccuggacuuucucccucagauaauacugaugucaagaggucuagcccaguccauaucagacagccaugcaaaauuccagauggaaaaucauauuuaaagucacaguaacauugugaucucuauuaagcacaacuucagcuacuagacaagaaugugggacagaaaagccagcucacugaggacaaagaugggggaggugggaauguggcugaucaggaccaggcaaagaguuagaacuccagccaagaguaccaagguucagugcagcuucauugccauuaagggaacugagaguuaggcagggacacugaaacaggaacucagaucagagaaugaaguugauuuauaagggggaagauaaaguuuacuagauaaaagagugcucaggacuccuuuucagcccacuggauacugugugcaaagcugcaguauuugugugggaagauccugcuaauguaaauuugccuugggucaguuuggcucuggggccuagcagaugaucuugaaaagcccaagagguauguuugguugugcccuggcuuaauuggagaugaauauagcauuucaugggcugcaggauacacggggaacacuguuguuccuuuaugauuuuucucaaagucuacuucuugcuagcuccugggacacugugacucaagguagaccuuccugucucugacuuuggaggccagugucccagauaagaguuguugcuuaggcccugggugcauggacaugaaacaugagcaaugaagcauuuggacuccaggguccagaagaugaaaaugagaaaauaucagagagcugccucagaagaagagagauggguaacccuuuucugcucuccuucuauccugaagauaauaaugugguaaccugcuuggaauaugagggcaggcaguuuccucacuguuuuuauaagggcuaggaaggcuagacauuuucuuacuuuggaaaacuguuuuucaggagucacugacuuacacacauacuggggugagauguaugugcgaauuaaauccaguguaagguugcaagagagaaaagugcaacuguggcaaacuacagagcacaucccuuaucuaaaggggaaucccacuacuuggauccagcuguuuguaaccauauggaaauauuuaauguugcaagaucuucuacauuuucaagagaauucagaaaucuggauuuuuuuuaaugaaguuguguuaaccauagucaaugaauuugaauaaagagcaaaaucacaaccaaagcaaagaggacaaacacaaaucccauagguucucaguuugugaccugauguugaaccagauccaugcaugaaggggguauuacuuuucuaucauggccauaacaaauugccacacauuuaguagcuuauuaucacaguuuccauagcucagaaguucaguaggcucaauuuugucucugcuuagagucucacaaugccaaaauuaagauauuggcagggcuguguuucuuucuggagucucugggagagaaucugcuugaucaugcacaaaaguggcagaauucaggucuaugcaguuaaaggacuuaggucccauuuccuugcuggcuguaagcugaaggucauuccuagccucuaggaccacuuacauucuuuggcucauggcccccuucuauuuucaaaacuagcaaugaugaguugaguucuucucaugccacaucucucugauacucucugucuccucugccuuccucuucugcuuuuagggacacaggauuacauuggacccauagaguaauccaggauucucuccuuauuuugaaauccauaacuuuaauuccaucugcagagucuaguuugccauguaacuuaauguacauagacauaagaccaggccaugaagauuauggcaagggagaugguaucaaaauccuguuucccacaaagguuucuuuuucucuagagaaauugauuauuuucucugauccaguaccagcuagccucaaucugauaccugaauguaaguauguuucucaacugugucaccucagccuggugcuaggugcucuagaccccagggagaggaaggaaagaaucagcucccagaccuuuaccugucuuguacucaguacccagugcccagcugagaagagccccugcuuuuggguaacccaguggcuuucugcuucgaguugcaggagguuugcugcaguuugaggcugauaaaacagcaaaggaggaaucucucuuccccgugccacccagcaaggagaccagugcugagucccaagugagugagaacaucuuucagacccagccacuuaacccuauccucgaggacgacugcagcucgacuaguggcuuccccacacaggaguccuuuaccauggccuccugcaccucagagagccacucccacuggguccacagccccaucgaaugcacagagcuggaccugcaaaaguuuuccagcucugccuccuauacuggagcugagaccuuggggggaaacacagucgaaagcacuggagacaggcuggagcucaaugugcccuuugaaguucccagcccuuaacucuaaugaggugagcuggaaagguggaucagaaaaaaacaaaaaaagcaaaacagaaauuaaggacuaaccucaaggaauucucuuuuggaauaguauuauucacuaggaguggaggaacagcagcaagcuaggaacacuuuggguggaggggcaacaguggugaugcuaaacuuuuaagccagacagauaucacacuucugggucuacaauugucagggaacuggcaagguugucaugauaccagucucuccauucuggucuuucguaagcucucucagggccccacuaucuaauggucauauucagguaucucccuuuaugugugcaagcagcauagcacaguagaaaaagauauacaagccuugucaucuggaaacccuacauuucaaaucaaccuucauucccuaauaacuauacaaaccuuguguguaugucacuucauuuuacauuuuacagaggcaggaacugagacacagagagggaaaguuaguuucucaaagucacagggcaaauuagugggcuagaacugugcaagaacccagguuugggggcuacauuuuagaguugguucaacuccaccauugcaaccauuugauagccaauguuacuuucucaaagcuuauguagcaugagguaggagaguagguagauucccaguuuucaacuaaccaaauaucuugcagugcccacuuccguauuucuucaguuaauacauuuucaguucucccaaugacuucccugcucccugcauccaaccuaagaaaacgugaacaaauguauauuugaaagucauaacugauaucaaauuugaaaguuauaacugaugucaaaucaaucaacuuagguaccuucaagguuaucuaguccaguucuucuuccaagguuuggguccauuuuauaauauccccacuaagaguuuguguaguccuugcucacauacuuuagguggcagagggcugacuacuucucaauguauauuacaguauacacaauugugacugguggguuugagcucaauguaagaaagagcuuucccuguaguacccgccuauccauccuggcucuguuccucgugccagacagaccucaucaguuuccucugcuuuaagauagcccugcagaggcuugaagacaacaccaccucucuggagaauaccacuuuagguucuucuaaaguauguggagcuuagaacuaaaccuaucuucaggauaaaugguuucaacaauguagaauaggguagaauugucauaucccuaucuagguaaugucuuucugcuauuacauccucaaccauuggcuuaaccuaugauauuuggagggguagagaaagaagggugcuagugagauuuccccacauguuucuaacuugguuugcucucuccuuaggucucuugggccccuggcagccuugcccaguuguucucucuggacucuguuccuauaccacaacagcagcaggggccugaaaugugauguccacaagagcuaauacccuacagauggggcauauccuaucccaucccaccagaggauugauucuccauuucacaaggacugaucuggagcauuucuugcuucccuuuuguagucuggggagccagauuccacauucaugggacuaccagacauguuccuagcucaacuugauuauagagaagaggagagaggacagugaaugggguaggguuuucaugucugcauuuuuggucagguaagccucucaaaauuguguuggcacaucuaccuagcacuuuagggacaaaaucaaacccuucuccccuuuuagcuccuccacacugucucccuccucaacacacacacacacacauacacacacauauacauagacacacaaacacacacacacacauuaauaucuaucuugggggaggccucgugccauaauucccaaguucaugucucagacugcugcauugcagcaugaggcagggcaaacacuuucccucuagaucccuggggccucacccuguauuugagguucucaccacccucagcagggagaagggcugaaguucgccauuuuggaaccuuacagaacauuucugagccaaaguaaucuuccuucuggggccugaguuccccaaacuaccccacagcagucccucaaagacagcccucaauccauguagggacaucugaguaugccucuuucuauugaaaugucaauucaaucccagcuuucucaccaccguuccccuuugauucuuucucaauugucuuuuugccuuuagcucccaccuauacaucucaugcucagagaaaaacaaguuccuuagagguuguauucuuuauucuccaagaaucugucugaaacuuguacagcuaguuccugucccacaacuauuaagugguuuauuaaguacauuaggcagaaugugcacuucaucaccagguucuagcucuggcaaaggagugcugucuacagcaagauuuuugcuuuuagaauuuuauuaacuacaucuuuuggguucauccaucuacaaacacugauuaagggccccuggggcaaccaauugaucagauuacuaaaaggacuugggaaaaagcaaaaaggucccauuguacuggacugaggauuagaagcaauugaaauacaagccuguaccaagcaagcagccuggccccacacagguauuagcaaauaugugguaaccaagguuuuaggccuuggccuuuagguuuccuguuuuuuuuuuguuuuuguuuuuguuuuuguuuuucugcaacagguuauucuuaucucacuggcuuucacugaucauguuuagaccuucugguagaagaaauaauauccagacaggggaugauuuggcuucagcaggcugcagguguucaaagguugccauguggcuggcagugguucaagcccacauuugacacugcugcucuagaggaaagauaaugaugguaacacaguaauaauaauaauaauaacaaaaauaugauaaagugaaagaguaagacuucuucagugugcuugcucauggcaugaaugcuauguggacagcccaagccauacccagaaucaccuuaauuccaacuuuuugagguucagcaauuggagguggcaauuggcuuugcauuuuaaaguauuucggguaaaggugaagugaaggauuuucgucuuuauaauuucuguuuggccauggcaaauaccauaguugaguauuugcuucaggagaguucuuuuuacaguuuuacuuuucaaugcugaggcauauuucuuugagcacugugcuuuuaugugucuuucuacaaagggguuauuggucaguggaagaacaaaguacacuugauaaaaacauuuucaacauacauugagccuaaacagcaguuaaguugucucuaaaugaacuagcaaaaaaaaaaaauguaguuuuuguuuguaaggaaggggagguauuuccugagaaugaauuuuuuuuuuuuuggauuacuguuuuucucuccauauaccuugacuuggauuuugacaggagggagccugggaaaauaauuuuuuccuccaagauucucagauccagguuaggaaaggauucagcacuacagcauaccccucuacaacauacagcccugucacauugagaucauaaucccuccugucccacuccucucuaccaaccccacccuacuagcuaggucuucaguguuuuacauugaauauugguacauuuuaauuauuuuuucucauaaauggguuauuuauagaaauuuuguuaacucuugagccauaugcauguguagauacuggcagggcuauguuuguuuaugaugcucugcaaacauuucauauuggccaauaaacagaaauauauccaa

SEQ ID NO: 193050 - DNA, 34 bp, Artificial Sequence
  Synthetic primer
  misc_feature (29)..(34): n is a, c, g, or t
ctttccctacacgacgctcttccgatctnnnnnn

SEQ ID NO: 193051 - DNA, 37 bp, Artificial Sequence
  Synthetic primer
caagcagaagacggcatacgagctcttccgatctggg

SEQ ID NO: 193052 - DNA, 58 bp, Artificial Sequence
  Synthetic primer
aatgatacggcgaccaccgagatctacactctttccctacacgacgctcttccgatct

SEQ ID NO: 193053 - DNA, 34 bp, Artificial Sequence
  Synthetic primer
caagcagaagacggcatacgagctcttccgatct

SEQ ID NO: 193054 - DNA, 18 bp, Artificial Sequence
  Synthetic primer
gccttttgtcacctcact

SEQ ID NO: 193055 - DNA, 20 bp, Artificial Sequence
  Synthetic primer
caaactcactgcaaggtctc

SEQ ID NO: 193056 - DNA, 20 bp, Artificial Sequence
  Synthetic primer
tactgggtctggattctctg

SEQ ID NO: 193057 - DNA, 20 bp, Artificial Sequence
  Synthetic primer
cagttccgtggtctttagtg

SEQ ID NO: 193058 - DNA, 20 bp, Artificial Sequence
  Synthetic primer
ggctatgctcatgctgtaac

SEQ ID NO: 193059 - DNA, 21 bp, Artificial Sequence
  Synthetic primer
gttactggcatctttctcaca

SEQ ID NO: 193060 - DNA, 20 bp, Artificial Sequence
  Synthetic primer
ccacaccgagattgagattg

SEQ ID NO: 193061 - DNA, 20 bp, Artificial Sequence
  Synthetic primer
gccaggagaaagaccattac

SEQ ID NO: 193062 - DNA, 18 bp, Artificial Sequence
  Synthetic primer
tgtgaaccctttcctgga

SEQ ID NO: 193063 - DNA, 19 bp, Artificial Sequence
  Synthetic primer
cttcacaggtctctagcca

SEQ ID NO: 193064 - DNA, 19 bp, Artificial Sequence
  Synthetic primer
cgaggacttcacgcacaac

SEQ ID NO: 193065 - DNA, 20 bp, Artificial Sequence
  Synthetic primer
ttacagttggagggtcctgg

SEQ ID NO: 193066 - DNA, 18 bp, Artificial Sequence
  Synthetic primer
caccctgaacatccaaca

SEQ ID NO: 193067 - DNA, 20 bp, Artificial Sequence
  Synthetic primer
catctgcttttcctacctgg

SEQ ID NO: 193068 - DNA, 17 bp, Artificial Sequence
  Synthetic primer
ggtccaaaatcggcagt

SEQ ID NO: 193069 - DNA, 20 bp, Artificial Sequence
  Synthetic primer
gtcctcaaatccctaccaga

SEQ ID NO: 193070 - DNA, 21 bp, Artificial Sequence
  Synthetic primer
acacggtcgtgaagctaggta

SEQ ID NO: 193071 - DNA, 21 bp, Artificial Sequence
  Synthetic primer
cagttggagtaggccattccc

SEQ ID NO: 193072 - DNA, 18 bp, Artificial Sequence
  Synthetic primer
agatgagtccaggtgctt

SEQ ID NO: 193073 - DNA, 19 bp, Artificial Sequence
  Synthetic primer
caagtccagagtagccaac

SEQ ID NO: 193074 - DNA, 21 bp, Artificial Sequence
  Synthetic primer
tgggctatttttccttactgg

SEQ ID NO: 193075 - DNA, 19 bp, Artificial Sequence
  Synthetic primer
gagtccctttgctgtgctg

SEQ ID NO: 193076 - DNA, 21 bp, Artificial Sequence
  Synthetic primer
gcgataaaggaagacacatgc

SEQ ID NO: 193077 - DNA, 20 bp, Artificial Sequence
  Synthetic primer
ccactccttactggctgctc

SEQ ID NO: 193078 - DNA, 21 bp, Artificial Sequence
  Synthetic primer
atgaagtccatggtgacagac

SEQ ID NO: 193079 - DNA, 20 bp, Artificial Sequence
  Synthetic primer
acgctctcgcatacacaatg

SEQ ID NO: 193080 - DNA, 20 bp, Artificial Sequence
  Synthetic primer
gttggggatgaagatgtcgt

SEQ ID NO: 193081 - DNA, 20 bp, Artificial Sequence
  Synthetic primer
gaggcacaagggaaaatgac

SEQ ID NO: 193082 - DNA, 20 bp, Artificial Sequence
  Synthetic primer
tggacttgctacccaaaagg

SEQ ID NO: 193083 - DNA, 20 bp, Artificial Sequence
  Synthetic primer
cgatgttgcccagttatcag

SEQ ID NO: 193084 - DNA, 22 bp, Artificial Sequence
  Synthetic primer
caactgacctcataagcagcac

SEQ ID NO: 193085 - DNA, 20 bp, Artificial Sequence
  Synthetic primer
aggctgctttctgcttcaca

SEQ ID NO: 193086 - DNA, 20 bp, Artificial Sequence
  Synthetic primer
atactgaagtgcccggagtg

SEQ ID NO: 193087 - DNA, 21 bp, Artificial Sequence
  Synthetic primer
caggggacagacatcagtgag

SEQ ID NO: 193088 - DNA, 53 bp, Artificial Sequence
  Synthetic primer
taatacgactcactatagggagacccatcggggccacggatacctgtgtgtcc

SEQ ID NO: 193089 - DNA, 30 bp, Artificial Sequence
  Synthetic primer
taataggtgaggtttcaatgatttacatcg

SEQ ID NO: 193090 - DNA, 55 bp, Artificial Sequence
  Synthetic primer
taatacgactcactatagggagattctgagacactgaccatgtgcccagtgcacc

SEQ ID NO: 193091 - DNA, 32 bp, Artificial Sequence
  Synthetic primer
cgtcgtgggtggagtcctcgcgctgggcttcc

SEQ ID NO: 193092 - DNA, 22 bp, Artificial Sequence
  Synthetic primer
atgctctgtgtcctctatcaga

SEQ ID NO: 193093 - DNA, 20 bp, Artificial Sequence
  Synthetic primer
gaagtcagtatggagggggt

SEQ ID NO: 193094 - DNA, 58 bp, Artificial Sequence
  Synthetic primer
ccgggcaagtgagaggacacataggctcgagcctatgtgtcctctcacttgctttttg

SEQ ID NO: 193095 - DNA, 58 bp, Artificial Sequence
  Synthetic primer
aattcaaaaagcaagtgagaggacacataggctcgagcctatgtgtcctctcacttgc

SEQ ID NO: 193096 - DNA, 20 bp, Artificial Sequence
  Synthetic primer
acgggaaattctgcgaaata

SEQ ID NO: 193097 - DNA, 20 bp, Artificial Sequence
  Synthetic primer
ctttccagagaacccaggtg

SEQ ID NO: 193098 - DNA, 23 bp, Artificial Sequence
  Synthetic primer
cattaccacagggaccccatttt

SEQ ID NO: 193099 - DNA, 23 bp, Artificial Sequence
  Synthetic primer
gatacggggaatttggcattgtt

SEQ ID NO: 193100 - DNA, 22 bp, Artificial Sequence
  Synthetic primer
ctgtctgcatttgacggtgaac

SEQ ID NO: 193101 - DNA, 22 bp, Artificial Sequence
  Synthetic primer
ctcctctcgcaggtaccacagt

SEQ ID NO: 193102 - DNA, 18 bp, Artificial Sequence
  Synthetic primer
gccgtaaagatgaccaca

SEQ ID NO: 193103 - DNA, 20 bp, Artificial Sequence
  Synthetic primer
ggagaaacccctaagctgta

SEQ ID NO: 193104 - DNA, 22 bp, Artificial Sequence
  Synthetic primer
agcatccctagacccgtacagt

SEQ ID NO: 193105 - DNA, 23 bp, Artificial Sequence
  Synthetic primer
gggttcctataaatacggactgc

SEQ ID NO: 193106 - DNA, 21 bp, Artificial Sequence
  Synthetic primer
gcaggcctagtaaccgagaca

SEQ ID NO: 193107 - DNA, 19 bp, Artificial Sequence
  Synthetic primer
agttttggcgatgggtgct

SEQ ID NO: 193108 - DNA, 22 bp, Artificial Sequence
  Synthetic primer
gtgtaacacgtctatacgccca

SEQ ID NO: 193109 - DNA, 15 bp, Artificial Sequence
  Synthetic primer
cactgcattttagca

SEQ ID NO: 193110 - DNA, 14 bp, Artificial Sequence
  Synthetic primer
aagtcagtatggag

SEQ ID NO: 193111 - DNA, 15 bp, Artificial Sequence
  Synthetic primer
aggggctggggctgg

SEQ ID NO: 193112 - DNA, 16 bp, Artificial Sequence
  Synthetic primer
atagacacacaaagca

SEQ ID NO: 193113 - DNA, 12 bp, Artificial Sequence
  Synthetic primer
aaagcccgccaa

SEQ ID NO: 193114 - DNA, 17 bp, Artificial Sequence
  Synthetic primer
gctaaatgcacacaggg

SEQ ID NO: 193115 - DNA, 16 bp, Artificial Sequence
  Synthetic primer
cagtgcagaggttttt

SEQ ID NO: 193116 - DNA, 20 bp, Artificial Sequence
  Synthetic primer
tgcaataactcacaaaacca

SEQ ID NO: 193117 - DNA, 20 bp, Artificial Sequence
  Synthetic primer
acccacccatccacccaccc

SEQ ID NO: 193118 - RNA, 28 nt, Mus musculus
uugcccaucggggccacggauaccugcu

SEQ ID NO: 193119 - RNA, 26 nt, Mus musculus
uugcgcaucgaggccacauaccugcu

SEQ ID NO: 193120 - RNA, 30 nt, Mus musculus
ucguguugacacuggcugggguagcagcca

SEQ ID NO: 193121 - RNA, 28 nt, Mus musculus
ucguugacacugagaaggguagcagcca

SEQ ID NO: 193122 - DNA, 112 bp, Mus musculus
tgctaaaatgcagtgtccatcactcagcctataagactgagacagcccatctataccccctccatactgacttctagagtcatggaatttcacttaatgcatagaatcgtat

SEQ ID NO: 193123 - DNA, 112 bp, Mus musculus
tgctaaaatgcagtgcccatcactcagcctataagactgagatagcccatctataccccctccatactgacttacagagtcatggagtttcacttaatgcatgcagtcctat

SEQ ID NO: 193124 - DNA, 119 bp, Mus musculus
tgctaaaatgcagtgcccataactcagcctataagactgagatagcccatttataccccataccccctccatactgacttctagggtcatggaatttcacttaatgcatagaatcgtat

SEQ ID NO: 193125 - DNA, 118 bp, Mus musculus
tgctaaaatgcagtgtccatcactcagtctataagactgagatatccctatgtataccccatactccctccatactgacttccagagtcatagaatttcactttgcatacggtcctat

SEQ ID NO: 193126 - DNA, 118 bp, Mus musculus; identical to SEQ ID NO: 193125

SEQ ID NO: 193127 - DNA, 112 bp, Mus musculus
tgctaaaatgcagtgcccatcactcagcctataagactgagatagcccatctataccccctccatactgacttccagagtcatggaatttcacttaatgcatgcagtcctat

SEQ ID NO: 193128 - DNA, 119 bp, Mus musculus
tgctaaaatgcagtgcccatcactcagcctataagactgagatagcccatctataccccataccccctccatactgacttccagagtcatggaatttcacttaatgcatgcagtcctat

SEQ ID NO: 193129 - DNA, 112 bp, Mus musculus
tgctaaaatgcagtgcccatcactcagcctataagactgagatagcccatctatacccactccatactgacttccagagtcatggaatttcacttaatgcatgcagtcctat

SEQ ID NO: 193130 - DNA, 112 bp, Mus musculus
tgctaaaatgcagtgcccatcactcagcctataagactgagatagcccatctatacccactccatactgacttccagagtcatggagtttcacttaatgcatgcagtcctat

SEQ ID NO: 193131 - DNA, 119 bp, Mus musculus
tgctaaaatgcagtgcccataactcagcctataagactgagatagcccatttataccccataccccctccatactgacttccagggtcatggaatttcacttaatgcatagaatcgtat

SEQ ID NO: 193132 - DNA, 118 bp, Mus musculus
tgctaaaatgcagtgtccattactcagcctataagactgagatatccctatgtataccccataccccctccatactgacttccagagacatagaatttcactttgcatacggtcctat

SEQ ID NO: 193133 - DNA, 120 bp, Mus musculus
tgctaaaatgcagtgcccatcactcagcctataagactgagatatccctatctataccctctaccccctccatactgacttccagagtcatggaatttcacataatgtatagatttctat

SEQ ID NO: 193134 - DNA, 112 bp, Mus musculus
tgctaaaatgcagtgcccataactcagcctataagactgagatagcccatctataccccctccatactgagttccagagtcatggaatttcacttaatgcatagaatcgtat

SEQ ID NO: 193135 - DNA, 113 bp, Mus musculus
tgctaaaatgcagtgcccatcactcagcctataagactgagcccatctataccccataccccctccatactgacttccagagtcatggaatttcactttgcatacagtcctac

SEQ ID NO: 193136 - DNA, 15 bp, Mus musculus
tgctaaaatgcagtg

SEQ ID NO: 193137 - DNA, 15 bp, Homo sapiens
tgctcaaaataagtt

SEQ ID NO: 193138 - DNA, 14 bp, Mus musculus
ctccatactgactt

SEQ ID NO: 193139 - DNA, 14 bp, Homo sapiens
ttcagtactgactc

SEQ ID NO: 193140 - DNA, 25 bp, Homo sapiens
ggaagctgtagctagaacatctgtt

SEQ ID NO: 193141 - DNA, 25 bp, Homo sapiens
caggtaagtagtctcctctatcatt

SEQ ID NO: 193142 - DNA, 25 bp, Homo sapiens
tctcaacccaaagcctgctttgtta

SEQ ID NO: 193143 - DNA, 25 bp, Homo sapiens
ccctctgacactgtaccatctcttt

SEQ ID NO: 193144 - DNA, 25 bp, Homo sapiens
agaagggtctaagtgcagacatctg

SEQ ID NO: 193145 - DNA, 19 bp, Homo sapiens
ccagaagagaaagggcact

SEQ ID NO: 193146 - DNA, 25 bp, Homo sapiens
gagcctttctttgactctctggtaa

SEQ ID NO: 193147 - DNA, 25 bp, Homo sapiens
ccacggagaagttccctgatggttt

SEQ ID NO: 193148 - DNA, 23 bp, Homo sapiens
gaagatcaagatcattgctcctc

SEQ ID NO: 193149 - DNA, 27 bp, Homo sapiens
ctgcacaaacttggttagttcaatttt

SEQ ID NO: 193150 - DNA, 25 bp, Homo sapiens
actgcaatgcaatggtttaaatacc

SEQ ID NO: 193151 - DNA, 40 bp, Homo sapiens
ttttttagtatgttctttaatgctggatcacagacagctc

SEQ ID NO: 193152 - DNA, 30 bp, Homo sapiens
atactcttttcaatgggatattatggttgt

SEQ ID NO: 193153 - DNA, 32 bp, Homo sapiens
tggtactggttatttctacatttatcttagtg

SEQ ID NO: 193154 - DNA, 40 bp, Homo sapiens
taacatgacatttagggactcaacatacattaaggtgatg

SEQ ID NO: 193155 - DNA, 21 bp, Homo sapiens
gccactgaaaattcagcttca

SEQ ID NO: 193156 - DNA, 24 bp, Homo sapiens
atccgcatccaactattaaaatgg

SEQ ID NO: 193157 - DNA, 20 bp, Homo sapiens
ccagcccaacccctaaagac

SEQ ID NO: 193158 - DNA, 23 bp, Homo sapiens
cctcaggaatcagctaaagcaaa

SEQ ID NO: 193159 - DNA, 29 bp, Homo sapiens
aaactgcagaacttttacctcggcatcca

SEQ ID NO: 193160 - DNA, 28 bp, Homo sapiens
cggaattcagcgagaacccagacctttc

SEQ ID NO: 193161 - DNA, 28 bp, Homo sapiens
cggaattcaacttttacctcggcatcca

SEQ ID NO: 193162 - DNA, 29 bp, Homo sapiens
aaactgcagagcgagaacccagacctttc

SEQ ID NO: 193163 - DNA, 28 bp, Homo sapiens
cggaattcaacttttacctcggcatcca

SEQ ID NO: 193164 - DNA, 29 bp, Homo sapiens
aaactgcagaacttttacctcggcatcca

SEQ ID NO: 193165 - DNA, 28 bp, Homo sapiens
cgggatccagcgagaacccagacctttc

SEQ ID NO: 193166 - DNA, 21 bp, Homo sapiens
aaaaccaaccctgacgacaga

SEQ ID NO: 193167 - DNA, 18 bp, Homo sapiens
gcagcgccatcagaggaa

SEQ ID NO: 193168 - DNA, 27 bp, Homo sapiens
catcatgtgcgcttggaatccaagaga

SEQ ID NO: 193169 - DNA, 22 bp, Homo sapiens
gcatttcaagtatcccgtgatg

SEQ ID NO: 193170 - DNA, 20 bp, Homo sapiens
tgttgagtagccgggatcct

SEQ ID NO: 193171 - DNA, 23 bp, Homo sapiens
agcgggcttcctacatgcctccc

SEQ ID NO: 193172 - DNA, 23 bp, Mus musculus
gtaggcagggaagctagtactga

SEQ ID NO: 193173 - DNA, 20 bp, Mus musculus
agaggcttgcagtccagttc

SEQ ID NO: 193174 - DNA, 17 bp, Mus musculus
cctggaaggagaaacag

SEQ ID NO: 193175 - DNA, 23 bp, Mus musculus
tctgccttgtagatgaggagtct

SEQ ID NO: 193176 - DNA, 25 bp, Mus musculus
cctgactagagtcctgctgttacta

SEQ ID NO: 193177 - DNA, 19 bp, Mus musculus
ctcaggctcctcactacag

SEQ ID NO: 193178 - DNA, 25 bp, Mus musculus
ccacagacgctcaacatcctggtgg

SEQ ID NO: 193179 - DNA, 25 bp, Mus musculus
gctcgagctgctatcagtttccaat

SEQ ID NO: 193180 - DNA, 25 bp, Homo sapiens
ccctctgacactgtaccatctcttt

SEQ ID NO: 193181 - DNA, 25 bp, Homo sapiens
agaagggtctaagtgcagacatctg

SEQ ID NO: 193182 - DNA, 19 bp, Homo sapiens
ccagaagagaaagggcact

SEQ ID NO: 193183 - DNA, 25 bp, Homo sapiens
gagcctttctttgactctctggtaa

SEQ ID NO: 193184 - DNA, 25 bp, Homo sapiens
ccacggagaagttccctgatggttt

SEQ ID NO: 193185 - DNA, 20 bp, Homo sapiens
tagcgaggtgacagcgtaga

SEQ ID NO: 193186 - DNA, 21 bp, Homo sapiens
ggggaagaaacttaaccttgg

SEQ ID NO: 193187 - DNA, 20 bp, Homo sapiens
ttggctgttgctgaagaatg

SEQ ID NO: 193188 - DNA, 20 bp, Homo sapiens
cagagcccaccatcaaaaac

SEQ ID NO: 193189 - DNA, 24 bp, Homo sapiens
taccatctcttttacccccatcct

SEQ ID NO: 193190 - DNA, 22 bp, Homo sapiens
aagctgcagtcaaatccatcaa

SEQ ID NO: 193191 - DNA, 20 bp, Homo sapiens
gcagagtggcaacatgaaga

SEQ ID NO: 193192 - DNA, 22 bp, Homo sapiens
tttctcctcctgatccgtagac

SEQ ID NO: 193193 - DNA, 22 bp, Homo sapiens
gtctacggatcaggaggagaaa

SEQ ID NO: 193194 - DNA, 20 bp, Homo sapiens
ccctaagtgttggcatttgg

SEQ ID NO: 193195 - DNA, 20 bp, Homo sapiens
gggcatgatgggagaataga

SEQ ID NO: 193196 - DNA, 20 bp, Homo sapiens
ccaaatgccaacacttaggg

SEQ ID NO: 193197 - DNA, 21 bp, Homo sapiens
cagagagacctactagttatt

SEQ ID NO: 193198 - DNA, 21 bp, Homo sapiens
taactagtaggtctctctgtt

SEQ ID NO: 193199 - DNA, 21 bp, Homo sapiens
cactgtgcgtgccaacatttt

SEQ ID NO: 193200 - DNA, 21 bp, Homo sapiens
aatgttggcacgcacagtgtt

SEQ ID NO: 193201 - DNA, 21 bp, Homo sapiens
cctctccacgcgcagtacatt

SEQ ID NO: 193202 - DNA, 21 bp, Homo sapiens
tgtactgcgcgtggagaggtt

SEQ ID NO: 193203 - DNA, 1055 bp, Homo sapiens
tctagcgaggtgacagcgtagaaccaggcggggtccctcccattacatactactgctctggcctctgcccgtcatagttgccatctggtcatttccttcccataaagccagggctcaccgcaacctccaccgtcctgagttaaagtgattctcctgtctcagccccctgagtagctaggattacaggcgtgcgccaccacacccagctaatttttgtacttttagtagagatgggatttcaccctgttggtcaggctggtcttgaactcctgacctagtgatctgcccaccttggcctcccaaagtgctgggattacaggcgtgagccaccacgcctggctaggggaagagtgcttttaagagctctgagtagaagggtctaagtgcagacatcttggctgttgctgaagaatgtgactctcaccgcctccctctgacactgtaccatctcttttacccccatccttagtccactcacggaggaggctgccttgatggatttgactagcagcttcaaacactttcttgggcaaacgaaggttggtggtgccactgtccacaatgctcttgtcatagttgtactaagagggaaaagagagagttaaaagagtcaaaaggtttttgatgctgggctctgggcagtagggggttactgctggggccccagctgggttggcatcttggctttggcacctcctaagtgtacctgcttggacaagttaacctctgtgcctcagttccttcatctctaaagtgaggataaaaatagcacctacctcaaagggttattgtaaggattaaataaatcagcaatgtaaagcacttagaatcgtgcccagcagagagaaggcacttggtaaatgtttattcttgttaatcttgggtgggcaggtagtctccaaacttgaaaaaaaaaaaaaagcaccttataaatcgtgccccgccagaagagaaagggcactttgggaaaaatggttttaattcccttgtttaaattctttgggggtggggggccaaggttaagtttcttccccaaaaacctttggaaaaaaatt

SEQ ID NO: 193204 - DNA, 250 bp, Homo sapiens
cttttaagagctctgagtagaagggtctaagtgcagacatcttggcttttgctgaagaatgtgactctcaccgcctccctctgacactgtaccatctcttttacccccatccttagtccactccacggaggaggctgccttgatggatttgactgcagcttcaaacactttcttgggcaaacgaaggttggtggtgccactgtccacaatgcctcttgtcatagttgtactaagagggaaaaaaaaaaaa

SEQ ID NO: 193205 - DNA, 1685 bp, Homo sapiens
gtctacggatcaggaggagaaagtgagatactggcctcataaagctgtgagtgggcatggtggctcacactgcctgtggtcccagaacttagaaggctaaggcatgaagttgtcaagttcaatgctaacctgggctacgttcatgaccccatctcaaaaaaaaaaaaaaaaaaaaaaaaggcatctcaatgccaagtcaacagagcagtggtttgtaagcgcctgatgggaaggatctacgtatctttagggcttgctgaggagtgtgactgtcactgaccgaggaggctgccttgatggacttgacggcagcttcaaatactttcttgggcaagcgaaggttggtggtcccactgtccacaatgctcttgtcgtagttgtactgaggagagagggggggagaggtgggaggggtgaatctgacagctaagcatcctactggggttggcatcttagctttcccattttgtatatgtgcgtccttgggcacgttgcttaacctctgtgtacctgttctcttgttctaaattgaagataataacagtgcctacctcaaaggttaccataaggattacataggtcaaaaggctgaaagcactaagtaggtcctggcagatcccaggcacttggtaagtactaacttcgtcaccttgtgcgggtaggtgttctctaaatctaaagcagaaatgccttgtgtggtatttgtaacttctagtacttttatgtagttattctcattcaccatacattataatggagagaagggtggctcagcacgcacaaagccatgagcttgagctctgatgctgcatggtggtatatgcctgtagagagacacttgagagtcagagaaaggaggaccaggagttcaaggtcatctttagctacctagcaagtctgaggtcagcgtgggctacataagatcctcaaaaaagccaaaaaagggggctgttgagataggtaagggcacctgctaccaagtctgatgacctcagttcaaccccagagagacctactagttactgaaaattgtcctctaacctccatacacaagctgtggcacatgccccatcctcatcccaataaatgtaaaacaaaatctagggaaagagaccctaagtgttggcatttgggtatgccaagcataacgactaacacttcatacattggctttgacctttacagtctgtgagaacgcttgtgtatttctacctctgccttgtagatgaggagtctggcactgtagtgaggagcctgagggcacttagtaacagcaggactctagtcaggtccaacctctgcctcacaaaagccttgcccaaggctgaagaggcagtgactagagtccagaaaggaactctttcatgttttcattactatacttaagtcatgtggtccaggctctgtgactgctctgccaggccccgcccttcaccttagggattgcctcgtgatcctgtgcttccaccctcatggctctcacacactgtgagactccccttatgctcacgagaatcccctccatcccattacctccttgcagtccatcttgagatcttgaccattgatttccacacgtacaatgatcacttcataataccactcccgccggatgggtgtgtaccagagactgcccgtgtatagcgagtggtcgataccaccaatgatctaaaagaaaaaaaaaa

SEQ ID NO: 193206 - DNA, 2028 bp, Homo sapiens
gtctacggatcaggaggagaaagtgagatactggcctcataaagctgtgactgggcatggtggctcacactgcctgtggtcccagaacttagaaggctaaggcatgaagttgtcaagttcaatgctaacctgggctacgttcatgaccccatctcaaaaaaaaaaaaaaaaaaaaaaaaggcatctcaatgccaagtcaacagagcagtggtttgtaagcgcctgatgggaaggatctacgtatctttagggcttgctgaggagtgtgactgtcactgaccgaggaggctgccttgatggacttgacggcagcttcaaatactttcttgggcaagcgaaggttggtggtcccactgtccacaatgctcttgtcgtagttgtactgaggagagagggggggagaggtgggaggggtgaatctgacagctaagcatcctactggggttggcatcttagctttcccattttgtatatgtgcgtccttgggcacgttgcttaacctctgtgtacctgttctcttgttctaaattgaagataataacagtgcctacctcaaaggttaccataaggattacataggtcaaaaggctgaaagcactaagtaggtcctggcagatcccaggcacttggtaagtactaacttcgtcaccttgtgcgggtaggtgttctctaaatctaaagcagaaatgccttgtgtggtatttgtaacttctagtacttttatgtagttattctcattcaccatacattataatggagagaagggtggctcagcacgcacaaagccatgagcttgagctctgatgctgcatggtggtatatgcctgtagagagacacttgagagtcagagaaaggaggaccaggagttcaaggtcatctttagctacctagcaagtctgaggtcagcgtgggctacataagatcctcaaaaaagccaaaaaagggggctgttgagataggtaagggcacctgctaccaagtctgatgacctgagttcaaccccagagagacctactagttactgaaaattgtcctctaacctccatacacaagctgtggcacatgccccatcctcatcccaataaatgtaaaacaaaatctagggaaagagaccctaagtgttggcatttgggtatgccaagcataacgactaacacttcatacattggctttgacctttacagtctgtgagaacgcttgtgtatttctacctctgccttgtagatgaggagtctggcactgtagtgaggagcctgagggcactctagtaacagcaggactctagtcaggtccaacctctgcctcacaaaagccttgcccaaggctgaagaggcagtgactagagtccagaaaggaactctttcatgttttcattactatacttaagtcatgtggtccaggctctgtgactgctctgccaggccccgcccttcaccttagggattgcctcgtgatcctgtgcttccaccctcatggctctcacacactgtgagactccccttatgctcacgagaatcccctccatcccattacctccttgcagtccatcttgagatcttgaccattgatttccacacgtacaatgatcacttcataataccactcccgccggagtgggtgtgtaccagagactgcccgtgtatagcgagtggtcgataccaccaatgatctaaaagaaaaagagacagacacctatgtcctagcacagaaggagagcaagttacccaagactaaataataagatcagccatttcttggggtgccaagattctctctaatctcccatcatgccccatgcatggtaatatttagtttcctaaatgtgttcaggagaagaaacacatcgggattatttgtatcaaaatctatagcccttgaccgaaagttatttaagccctaagctagtacaataaacgtggaatgaactgattgtatgctgctttcatacattttcttgtctttgcttgttggagaatacttgttactgtcctaattaataaatgggcttgaactgaaaaaaaaaaaaa

SEQ ID NO: 193207 - DNA, 897 bp, Homo sapiens
agagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggg

SEQ ID NO: 193208 - DNA, 932 bp, Homo sapiens
  modified_base (885)..(885): a, c, t, g, unknown or other
  misc_feature (885)..(885): n is a, c, g, or t
  modified_base (895)..(895): a, c, t, g, unknown or other
  misc_feature (895)..(895): n is a, c, g, or t
  modified_base (899)..(899): a, c, t, g, unknown or other
  misc_feature (899)..(899): n is a, c, g, or t
  modified_base (915)..(915): a, c, t, g, unknown or other
  misc_feature (915)..(915): n is a, c, g, or t
  modified_base (926)..(927): a, c, t, g, unknown or other
  misc_feature (926)..(927): n is a, c, g, or t
cagcttctcttgcagctcgtgcagcttctggcgcgcgccctcttggagctctgcgcgcagcggctccaccttctggcggtagagctccatctcctcctgccacttcttctggaagtcgtccagatccaaatggcaaaccttcttcatccaccaggacccaacccacaggctacttattgctggaaacctacgttgttccttggattgaagtaatctctccctcttctggtgcgcccacagcacttgcaccaacagtgggtacccaacagactagcgtgcctgccgaagaaggggtcctctgacaatcaggggacaatggggaattatgctctccagactttctacacacacaagtcacacaggaaggaaggtaaagagaaactagagaaaataatttttgaagaaaaacatttcaggaagtattgaaagtacacggtaactcagcctggggcaggggtggagggcagcagcactgtttgctgcagctatgctccttcctcagtgccctgcacacccgggacttgctcggtgagcatctctcgtgtcagtgacagctagtgtgagtactcttatgttcagctgcccctgactacctcttgactttggggacaagttacttaatctctgtgcctccgctgtttcactggtaaatgggaataagagttggttattctagggttgtagggttgttgtaaggattaaatgaatccgtatgtgaacagcatttggtgcctggcacatgtgagctcagccgggcgcggtggctcatgcctgtaatcccagcactttgggaggccaaggcgtgcggatcacgaggtcaggagatcgagaccatcctggctaacacggtgaaaccctgtctctactaaaaatacaaaaaattancggggcgtgntggngggacatgtagtcccngctactcgggnngctga

SEQ ID NO: 193209 - DNA, 13 bp, Artificial Sequence
  Description of Artificial Sequence: Synthetic oligonucleotide
tggagctcagttt

SEQ ID NO: 193210 - DNA, 14 bp, Artificial Sequence
  Description of Artificial Sequence: Synthetic oligonucleotide
tttctcgtgcagct

SEQ ID NO: 193211 - DNA, 14 bp, Artificial Sequence
  Description of Artificial Sequence: Synthetic oligonucleotide
ttctggcgcgtgcc

SEQ ID NO: 193212 - DNA, 14 bp, Artificial Sequence
  Description of Artificial Sequence: Synthetic oligonucleotide
ccctcgtggagctc

SEQ ID NO: 193213 - DNA, 14 bp, Artificial Sequence
  Description of Artificial Sequence: Synthetic oligonucleotide
gcccgcgcgcagcg

SEQ ID NO: 193214 - DNA, 14 bp, Artificial Sequence
  Description of Artificial Sequence: Synthetic oligonucleotide
cggctccaccttct

SEQ ID NO: 193215 - DNA, 14 bp, Artificial Sequence
  Description of Artificial Sequence: Synthetic oligonucleotide
ctggcggtagagct

SEQ ID NO: 193216 - DNA, 14 bp, Artificial Sequence
  Description of Artificial Sequence: Synthetic oligonucleotide
gctcgtgcagcttc

SEQ ID NO: 193217 - DNA, 14 bp, Artificial Sequence
  Description of Artificial Sequence: Synthetic oligonucleotide
cagcttctggcgcg

SEQ ID NO: 193218 - DNA, 14 bp, Artificial Sequence
  Description of Artificial Sequence: Synthetic oligonucleotide
gcgcgcagcggctc

SEQ ID NO: 193219 - DNA, 14 bp, Artificial Sequence
  Description of Artificial Sequence: Synthetic oligonucleotide
tccaccttctggcg

SEQ ID NO: 193220 - DNA, 14 bp, Artificial Sequence
  Description of Artificial Sequence: Synthetic oligonucleotide
cggtgtagagctcc

SEQ ID NO: 193221 - DNA, 14 bp, Artificial Sequence
  Description of Artificial Sequence: Synthetic oligonucleotide
ccatctcctcctgc

SEQ ID NO: 193222 - DNA, 19 bp, Artificial Sequence
  Description of Artificial Sequence: Synthetic oligonucleotide
gaagtcgtccagatccaaa

SEQ ID NO: 193223 - DNA, 19 bp, Artificial Sequence
  Description of Artificial Sequence: Synthetic oligonucleotide
aagtcgtccagatccaaat

SEQ ID NO: 193224 - DNA, 19 bp, Artificial Sequence
  Description of Artificial Sequence: Synthetic oligonucleotide
agtcgtccagatccaaatg

SEQ ID NO: 193225 - DNA, 19 bp, Artificial Sequence
  Description of Artificial Sequence: Synthetic oligonucleotide
gtcgtccagatccaaatgg

SEQ ID NO: 193226 - DNA, 19 bp, Artificial Sequence
  Description of Artificial Sequence: Synthetic oligonucleotide
tcgtccagatccaaatggc

SEQ ID NO: 193227 - DNA, 19 bp, Artificial Sequence
  Description of Artificial Sequence: Synthetic oligonucleotide
cgtccagatccaaatggca

SEQ ID NO: 193228 - DNA, 19 bp, Artificial Sequence
  Description of Artificial Sequence: Synthetic oligonucleotide
gtccagatccaaatggcaa

SEQ ID NO: 193229 - DNA, 19 bp, Artificial Sequence
  Description of Artificial Sequence: Synthetic oligonucleotide
tccagatccaaatggcaaa

SEQ ID NO: 193230 - DNA, 12 bp, Artificial Sequence
  Description of Artificial Sequence: Synthetic oligonucleotide
cagatccaaatg

SEQ ID NO: 193231 - DNA, 16 bp, Artificial Sequence
  Description of Artificial Sequence: Synthetic oligonucleotide
agatccaaatggcaaa

SEQ ID NO: 193232 - DNA, 12 bp, Artificial Sequence
  Description of Artificial Sequence: Synthetic oligonucleotide
agatccaaatgg

SEQ ID NO: 193233 - DNA, 12 bp, Artificial Sequence
  Description of Artificial Sequence: Synthetic oligonucleotide
gatccaaatggc

SEQ ID NO: 193234 - DNA, 12 bp, Artificial Sequence
  Description of Artificial Sequence: Synthetic oligonucleotide
atccaaatggca

SEQ ID NO: 193235 - DNA, 12 bp, Artificial Sequence
  Description of Artificial Sequence: Synthetic oligonucleotide
tccaaatggcaa

SEQ ID NO: 193236 - DNA, 12 bp, Artificial Sequence
  Description of Artificial Sequence: Synthetic oligonucleotide
ccaaatggcaaa

SEQ ID NO: 193237 - DNA, 19 bp, Artificial Sequence
  Description of Artificial Sequence: Synthetic oligonucleotide
ccaaatggcaaaccttctt

SEQ ID NO: 193238 - DNA, 19 bp, Artificial Sequence
  Description of Artificial Sequence: Synthetic oligonucleotide
atggcaaatcttcttcatc

SEQ ID NO: 193239 - DNA, 19 bp, Artificial Sequence
  Description of Artificial Sequence: Synthetic oligonucleotide
aaatggcaaaccttcttca

SEQ ID NO: 193240 - DNA, 19 bp, Artificial Sequence
  Description of Artificial Sequence: Synthetic oligonucleotide
aaatggcaaatcttcttca

SEQ ID NO: 193241 - DNA, 19 bp, Artificial Sequence
  Description of Artificial Sequence: Synthetic oligonucleotide
atggcaaaccttcttcatc

SEQ ID NO: 193242 - DNA, 19 bp, Artificial Sequence
  Description of Artificial Sequence: Synthetic oligonucleotide
ccaaatggcaaatcttctt

SEQ ID NO: 193243 - DNA, 15 bp, Artificial Sequence
  Description of Artificial Sequence: Synthetic oligonucleotide
atggcaaaccttctt

SEQ ID NO: 193244 - DNA, 15 bp, Artificial Sequence
  Description of Artificial Sequence: Synthetic oligonucleotide
atggcaaatcttctt

SEQ ID NO: 193245 - DNA, 11 bp, Artificial Sequence
  Description of Artificial Sequence: Synthetic oligonucleotide
cttcttcatcc

SEQ ID NO: 193246 - DNA, 17 bp, Artificial Sequence
  Description of Artificial Sequence: Synthetic oligonucleotide
ccaggacccaacccaca

SEQ ID NO: 193247 - DNA, 14 bp, Artificial Sequence
  Description of Artificial Sequence: Synthetic oligonucleotide
gctacttattgctg

SEQ ID NO: 193248 - DNA, 14 bp, Artificial Sequence
  Description of Artificial Sequence: Synthetic oligonucleotide
tgctggaaacctac

SEQ ID NO: 193249 - DNA, 14 bp, Artificial Sequence
  Description of Artificial Sequence: Synthetic oligonucleotide
ttccttggattgaa

SEQ ID NO: 193250 - DNA, 16 bp, Artificial Sequence
  Description of Artificial Sequence: Synthetic oligonucleotide
gcccacagcacttgca

SEQ ID NO: 193251 - DNA, 16 bp, Artificial Sequence
  Description of Artificial Sequence: Synthetic oligonucleotide
caccaacagtgggtac

SEQ ID NO: 193252 - DNA, 12 bp, Artificial Sequence
  Description of Artificial Sequence: Synthetic oligonucleotide
caacagactagc

SEQ ID NO: 193253 - DNA, 14 bp, Artificial Sequence
  Description of Artificial Sequence: Synthetic oligonucleotide
gaagaaggggtcct

SEQ ID NO: 193254 - DNA, 14 bp, Artificial Sequence
  Description of Artificial Sequence: Synthetic oligonucleotide
gaattatgctctcc

SEQ ID NO: 193255 - DNA, 14 bp, Artificial Sequence
  Description of Artificial Sequence: Synthetic oligonucleotide
ctccagactttcta

SEQ ID NO: 193256 - DNA, 16 bp, Artificial Sequence
  Description of Artificial Sequence: Synthetic oligonucleotide
aagtcacacaggaagg

SEQ ID NO: 193257 - DNA, 14 bp, Artificial Sequence
  Description of Artificial Sequence: Synthetic oligonucleotide
gaaactagagaaaa

SEQ ID NO: 193258 - DNA, 14 bp, Artificial Sequence
  Description of Artificial Sequence: Synthetic oligonucleotide
aataatttttgaag

SEQ ID NO: 193259 - DNA, 14 bp, Artificial Sequence
  Description of Artificial Sequence: Synthetic oligonucleotide
gaagtattgaaagt

SEQ ID NO: 193260 - DNA, 14 bp, Artificial Sequence
  Description of Artificial Sequence: Synthetic oligonucleotide
tgaaagtacacggt

SEQ ID NO: 193261 - DNA, 14 bp, Artificial Sequence
  Description of Artificial Sequence: Synthetic oligonucleotide
ctggggcaggggtg

SEQ ID NO: 193262 - DNA, 14 bp, Artificial Sequence
  Description of Artificial Sequence: Synthetic oligonucleotide
ggggtggagggcag

SEQ ID NO: 193263 - DNA, 14 bp, Artificial Sequence
  Description of Artificial Sequence: Synthetic oligonucleotide
tgctccttcctcag

SEQ ID NO: 193264 - DNA, 15 bp, Artificial Sequence
  Description of Artificial Sequence: Synthetic oligonucleotide
acccgggacttgctc

SEQ ID NO: 193265 - DNA, 14 bp, Artificial Sequence
  Description of Artificial Sequence: Synthetic oligonucleotide
tgtcagtgacagct

SEQ ID NO: 193266 - DNA, 19 bp, Artificial Sequence
  Description of Artificial Sequence: Synthetic oligonucleotide
tgtcagtgacagctagtgt

SEQ ID NO: 193267 - DNA, 19 bp, Artificial Sequence
  Description of Artificial Sequence: Synthetic oligonucleotide
gtcagtgacagctagtgtg

SEQ ID NO: 193268 - DNA, 19 bp, Artificial Sequence
  Description of Artificial Sequence: Synthetic oligonucleotide
tcagtgacagctagtgtga

SEQ ID NO: 193269 - DNA, 19 bp, Artificial Sequence
  Description of Artificial Sequence: Synthetic oligonucleotide
agtgacagctagtgtgagt

SEQ ID NO: 193270 - DNA, 15 bp, Artificial Sequence
  Description of Artificial Sequence: Synthetic oligonucleotide
tgacagctagtgtga

SEQ ID NO: 193271 - DNA, 19 bp, Artificial Sequence
  Description of Artificial Sequence: Synthetic oligonucleotide
tgacagctagtgtgagtac

SEQ ID NO: 193272 - DNA, 19 bp, Artificial Sequence
  Description of Artificial Sequence: Synthetic oligonucleotide
gacagctagtgtgagtact

SEQ ID NO: 193273 - DNA, 19 bp, Artificial Sequence
  Description of Artificial Sequence: Synthetic oligonucleotide
cagctagtgtgagtactct

SEQ ID NO: 193274 - DNA, 19 bp, Artificial Sequence
  Description of Artificial Sequence: Synthetic oligonucleotide
agctagtgtgagtactctt

SEQ ID NO: 193275 - DNA, 19 bp, Artificial Sequence
  Description of Artificial Sequence: Synthetic oligonucleotide
gctagtgtgagtactctta

SEQ ID NO: 193276 - DNA, 19 bp, Artificial Sequence
  Description of Artificial Sequence: Synthetic oligonucleotide
ctagtgtgagtactcttat

SEQ ID NO: 193277 - DNA, 14 bp, Artificial Sequence
  Description of Artificial Sequence: Synthetic oligonucleotide
ctagtgtgagtact

SEQ ID NO: 193278 - DNA, 19 bp, Artificial Sequence
  Description of Artificial Sequence: Synthetic oligonucleotide
tagtgtgagtactcttatg

SEQ ID NO: 193279 - DNA, 19 bp, Artificial Sequence
  Description of Artificial Sequence: Synthetic oligonucleotide
agtgtgagtactcttatgt

SEQ ID NO: 193280 - DNA, 19 bp, Artificial Sequence
  Description of Artificial Sequence: Synthetic oligonucleotide
gtgtgagtactcttatgtt

SEQ ID NO: 193281 - DNA, 19 bp, Artificial Sequence
  Description of Artificial Sequence: Synthetic oligonucleotide
tgtgagtactcttatgttc

SEQ ID NO: 193282 - DNA, 19 bp, Artificial Sequence
  Description of Artificial Sequence: Synthetic oligonucleotide
gtgagtactcttatgttca

SEQ ID NO: 193283 - DNA, 19 bp, Artificial Sequence
  Description of Artificial Sequence: Synthetic oligonucleotide
tgagtactcttatgttcag

SEQ ID NO: 193284 - DNA, 14 bp, Artificial Sequence
  Description of Artificial Sequence: Synthetic oligonucleotide
actcttatgttcag

SEQ ID NO: 193285 - DNA, 14 bp, Artificial Sequence
  Description of Artificial Sequence: Synthetic oligonucleotide
tacctcttgacttt

SEQ ID NO: 193286 - DNA, 14 bp, Artificial Sequence
  Description of Artificial Sequence: Synthetic oligonucleotide
gactttggggacaa

SEQ ID NO: 193287 - DNA, 13 bp, Artificial Sequence
  Description of Artificial Sequence: Synthetic oligonucleotide
aaactgagctcca

SEQ ID NO: 193288 - DNA, 14 bp, Artificial Sequence
  Description of Artificial Sequence: Synthetic oligonucleotide
agctgcacgagaaa

SEQ ID NO: 193289 - DNA, 14 bp, Artificial Sequence
  Description of Artificial Sequence: Synthetic oligonucleotide
ggcacgcgccagaa

SEQ ID NO: 193290 - DNA, 14 bp, Artificial Sequence
  Description of Artificial Sequence: Synthetic oligonucleotide
gagctccacgaggg

SEQ ID NO: 193291 - DNA, 14 bp, Artificial Sequence
  Description of Artificial Sequence: Synthetic oligonucleotide
cgctgcgcgcgggc

SEQ ID NO: 193292 - DNA, 14 bp, Artificial Sequence
  Description of Artificial Sequence: Synthetic oligonucleotide
agaaggtggagccg

SEQ ID NO: 193293 - DNA, 14 bp, Artificial Sequence
  Description of Artificial Sequence: Synthetic oligonucleotide
agctctaccgccag

SEQ ID NO: 193294 - DNA, 14 bp, Artificial Sequence
  Description of Artificial Sequence: Synthetic oligonucleotide
gaagctgcacgagc

SEQ ID NO: 193295 - DNA, 14 bp, Artificial Sequence
  Description of Artificial Sequence: Synthetic oligonucleotide
cgcgccagaagctg

SEQ ID NO: 193296 - DNA, 14 bp, Artificial Sequence
  Description of Artificial Sequence: Synthetic oligonucleotide
gagccgctgcgcgc

SEQ ID NO: 193297 - DNA, 14 bp, Artificial Sequence
  Description of Artificial Sequence: Synthetic oligonucleotide
cgccagaaggtgga

SEQ ID NO: 193298 - DNA, 14 bp, Artificial Sequence
  Description of Artificial Sequence: Synthetic oligonucleotide
ggagctctacaccg

SEQ ID NO: 193299 - DNA, 14 bp, Artificial Sequence
  Description of Artificial Sequence: Synthetic oligonucleotide
gcaggaggagatgg

SEQ ID NO: 193300 - DNA, 19 bp, Artificial Sequence
  Description of Artificial Sequence: Synthetic oligonucleotide
tttggatctggacgacttc

SEQ ID NO: 193301 - DNA, 19 bp, Artificial Sequence
  Description of Artificial Sequence: Synthetic oligonucleotide
atttggatctggacgactt

SEQ ID NO: 193302 - DNA, 19 bp, Artificial Sequence
  Description of Artificial Sequence: Synthetic oligonucleotide
catttggatctggacgact

SEQ ID NO: 193303 - DNA, 19 bp, Artificial Sequence
  Description of Artificial Sequence: Synthetic oligonucleotide
ccatttggatctggacgac

SEQ ID NO: 193304 - DNA, 19 bp, Artificial Sequence
  Description of Artificial Sequence: Synthetic oligonucleotide
gccatttggatctggacga

SEQ ID NO: 193305 - DNA, 19 bp, Artificial Sequence
  Description of Artificial Sequence: Synthetic oligonucleotide
tgccatttggatctggacg

SEQ ID NO: 193306 - DNA, 19 bp, Artificial Sequence
  Description of Artificial Sequence: Synthetic oligonucleotide
ttgccatttggatctggac

SEQ ID NO: 193307 - DNA, 19 bp, Artificial Sequence
  Description of Artificial Sequence: Synthetic oligonucleotide
tttgccatttggatctgga

SEQ ID NO: 193308 - DNA, 12 bp, Artificial Sequence
  Description of Artificial Sequence: Synthetic oligonucleotide
catttggatctg

SEQ ID NO: 193309 - DNA, 16 bp, Artificial Sequence
  Description of Artificial Sequence: Synthetic oligonucleotide
tttgccatttggatct

SEQ ID NO: 193310 - DNA, 12 bp, Artificial Sequence
  Description of Artificial Sequence: Synthetic oligonucleotide
ccatttggatct

SEQ ID NO: 193311 - DNA, 12 bp, Artificial Sequence
  Description of Artificial Sequence: Synthetic oligonucleotide
gccatttggatc

SEQ ID NO: 193312 - DNA, 12 bp, Artificial Sequence
  Description of Artificial Sequence: Synthetic oligonucleotide
tgccatttggat

SEQ ID NO: 193313 - DNA, 12 bp, Artificial Sequence
  Description of Artificial Sequence: Synthetic oligonucleotide
tgccatttggat

SEQ ID NO: 193314 - DNA, 12 bp, Artificial Sequence
  Description of Artificial Sequence: Synthetic oligonucleotide
tttgccatttgg

SEQ ID NO: 193315 - DNA, 19 bp, Artificial Sequence
  Description of Artificial Sequence: Synthetic oligonucleotide
aagaaggtttgccatttgg

SEQ ID NO: 193316 - DNA, 19 bp, Artificial Sequence
  Description of Artificial Sequence: Synthetic oligonucleotide
gatgaagaagatttgccat

SEQ ID NO: 193317 - DNA, 19 bp, Artificial Sequence
  Description of Artificial Sequence: Synthetic oligonucleotide
tgaagaaggtttgccattt

SEQ ID NO: 193318 - DNA, 19 bp, Artificial Sequence
  Description of Artificial Sequence: Synthetic oligonucleotide
tgaagaagatttgccattt

SEQ ID NO: 193319 - DNA, 19 bp, Artificial Sequence
  Description of Artificial Sequence: Synthetic oligonucleotide
gatgaagaaggtttgccat

SEQ ID NO: 193320 - DNA, 19 bp, Artificial Sequence
  Description of Artificial Sequence: Synthetic oligonucleotide
aagaagatttgccatttgg

SEQ ID NO: 193321 - DNA, 15 bp, Artificial Sequence
  Description of Artificial Sequence: Synthetic oligonucleotide
aagaaggtttgccat

SEQ ID NO: 193322 - DNA, 15 bp, Artificial Sequence
  Description of Artificial Sequence: Synthetic oligonucleotide
aagaagatttgccat

SEQ ID NO: 193323 - DNA, 11 bp, Artificial Sequence
  Description of Artificial Sequence: Synthetic oligonucleotide
ggatgaagaag

SEQ ID NO: 193324 - DNA, 17 bp, Artificial Sequence
  Description of Artificial Sequence: Synthetic oligonucleotide
tgtgggttgggtcctgg

SEQ ID NO: 193325 - DNA, 14 bp, Artificial Sequence
  Description of Artificial Sequence: Synthetic oligonucleotide
cagcaataagtagc

SEQ ID NO: 193326 - DNA, 14 bp, Artificial Sequence
  Description of Artificial Sequence: Synthetic oligonucleotide
gtaggtttccagca

SEQ ID NO: 193327 - DNA, 14 bp, Artificial Sequence
  Description of Artificial Sequence: Synthetic oligonucleotide
ttcaatccaaggaa

SEQ ID NO: 193328 - DNA, 16 bp, Artificial Sequence
  Description of Artificial Sequence: Synthetic oligonucleotide
tgcaagtgctgtgggc

SEQ ID NO: 193329 - DNA, 16 bp, Artificial Sequence
  Description of Artificial Sequence: Synthetic oligonucleotide
gtacccactgttggtg

SEQ ID NO: 193330 - DNA, 12 bp, Artificial Sequence
  Description of Artificial Sequence: Synthetic oligonucleotide
gctagtctgttg

SEQ ID NO: 193331 - DNA, 14 bp, Artificial Sequence
  Description of Artificial Sequence: Synthetic oligonucleotide
aggaccccttcttc

SEQ ID NO: 193332 - DNA, 14 bp, Artificial Sequence
  Description of Artificial Sequence: Synthetic oligonucleotide
ggagagcataattc

SEQ ID NO: 193333 - DNA, 14 bp, Artificial Sequence
  Description of Artificial Sequence: Synthetic oligonucleotide
tagaaagtctggag

SEQ ID NO: 193334 - DNA, 16 bp, Artificial Sequence
  Description of Artificial Sequence: Synthetic oligonucleotide
ccttcctgtgtgactt

SEQ ID NO: 193335 - DNA, 14 bp, Artificial Sequence
  Description of Artificial Sequence: Synthetic oligonucleotide
ttttctctagtttc

SEQ ID NO: 193336 - DNA, 14 bp, Artificial Sequence
  Description of Artificial Sequence: Synthetic oligonucleotide
cttcaaaaattatt

SEQ ID NO: 193337 - DNA, 14 bp, Artificial Sequence
  Description of Artificial Sequence: Synthetic oligonucleotide
actttcaatacttc

SEQ ID NO: 193338 - DNA, 14 bp, Artificial Sequence
  Description of Artificial Sequence: Synthetic oligonucleotide
accgtgtactttca

SEQ ID NO: 193339 - DNA, 14 bp, Artificial Sequence
  Description of Artificial Sequence: Synthetic oligonucleotide
cacccctgccccag

SEQ ID NO: 193340 - DNA, 14 bp, Artificial Sequence
  Description of Artificial Sequence: Synthetic oligonucleotide
ctgccctccacccc

SEQ ID NO: 193341 - DNA, 14 bp, Artificial Sequence
  Description of Artificial Sequence: Synthetic oligonucleotide
ctgaggaaggagca

SEQ ID NO: 193342 - DNA, 15 bp, Artificial Sequence
  Description of Artificial Sequence: Synthetic oligonucleotide
gagcaagtcccgggt

SEQ ID NO: 193343 - DNA, 14 bp, Artificial Sequence
  Description of Artificial Sequence: Synthetic oligonucleotide
agctgtcactgaca

SEQ ID NO: 193344 - DNA, 19 bp, Artificial Sequence
  Description of Artificial Sequence: Synthetic oligonucleotide
acactagctgtcactgaca

SEQ ID NO: 193345 - DNA, 19 bp, Artificial Sequence
  Description of Artificial Sequence: Synthetic oligonucleotide
cacactagctgtcactgac

SEQ ID NO: 193346 - DNA, 19 bp, Artificial Sequence
  Description of Artificial Sequence: Synthetic oligonucleotide
tcacactagctgtcactga

SEQ ID NO: 193347 - DNA, 19 bp, Artificial Sequence
  Description of Artificial Sequence: Synthetic oligonucleotide
actcacactagctgtcact

SEQ ID NO: 193348 - DNA, 15 bp, Artificial Sequence
  Description of Artificial Sequence: Synthetic oligonucleotide
tcacactagctgtca

SEQ ID NO: 193349 - DNA, 19 bp, Artificial Sequence
  Description of Artificial Sequence: Synthetic oligonucleotide
gtactcacactagctgtca

SEQ ID NO: 193350 - DNA, 19 bp, Artificial Sequence
  Description of Artificial Sequence: Synthetic oligonucleotide
agtactcacactagctgtc

SEQ ID NO: 193351 - DNA, 19 bp, Artificial Sequence
  Description of Artificial Sequence: Synthetic oligonucleotide
agagtactcacactagctg

SEQ ID NO: 193352 - DNA, 19 bp, Artificial Sequence
  Description of Artificial Sequence: Synthetic oligonucleotide
aagagtactcacactagct

SEQ ID NO: 193353 - DNA, 19 bp, Artificial Sequence
  Description of Artificial Sequence: Synthetic oligonucleotide
taagagtactcacactagc

SEQ ID NO: 193354 - DNA, 19 bp, Artificial Sequence
  Description of Artificial Sequence: Synthetic oligonucleotide
ataagagtactcacactag

SEQ ID NO: 193355 - DNA, 14 bp, Artificial Sequence
  Description of Artificial Sequence: Synthetic oligonucleotide
agtactcacactag

SEQ ID NO: 193356 - DNA, 19 bp, Artificial Sequence
  Description of Artificial Sequence: Synthetic oligonucleotide
cataagagtactcacacta

SEQ ID NO: 193357 - DNA, 19 bp, Artificial Sequence
  Description of Artificial Sequence: Synthetic oligonucleotide
acataagagtactcacact

SEQ ID NO: 193358 - DNA, 19 bp, Artificial Sequence
  Description of Artificial Sequence: Synthetic oligonucleotide
aacataagagtactcacac

SEQ ID NO: 193359 - DNA, 19 bp, Artificial Sequence
  Description of Artificial Sequence: Synthetic oligonucleotide
gaacataagagtactcaca

SEQ ID NO: 193360 - DNA, 19 bp, Artificial Sequence
  Description of Artificial Sequence: Synthetic oligonucleotide
tgaacataagagtactcac

SEQ ID NO: 193361 - DNA, 19 bp, Artificial Sequence
  Description of Artificial Sequence: Synthetic oligonucleotide
ctgaacataagagtactca

SEQ ID NO: 193362 - DNA, 14 bp, Artificial Sequence
  Description of Artificial Sequence: Synthetic oligonucleotide
ctgaacataagagt

SEQ ID NO: 193363 - DNA, 14 bp, Artificial Sequence
  Description of Artificial Sequence: Synthetic oligonucleotide
aaagtcaagaggta

SEQ ID NO: 193364 - DNA, 14 bp, Artificial Sequence
  Description of Artificial Sequence: Synthetic oligonucleotide
ttgtccccaaagtc

SEQ ID NO: 193365 - DNA, 15 bp, Artificial Sequence
  Description of Artificial Sequence: Synthetic oligonucleotide
aagaaggtttgccat

SEQ ID NO: 193366 - DNA, 15 bp, Artificial Sequence
  Description of Artificial Sequence: Synthetic oligonucleotide
tcacactagctgtca

SEQ ID NO: 193367 - DNA, 15 bp, Artificial Sequence
  Description of Artificial Sequence: Synthetic oligonucleotide
aagaaggtttgccat

SEQ ID NO: 193368 - DNA, 15 bp, Artificial Sequence
  Description of Artificial Sequence: Synthetic oligonucleotide
tcacactagctgtca

SEQ ID NO: 193369 - DNA, 21 bp, Artificial Sequence
  Description of Artificial Sequence: Synthetic primer
ctcctcctgccacttcttctg

SEQ ID NO: 193370 - DNA, 22 bp, Artificial Sequence
  Description of Artificial Sequence: Synthetic primer
ctggtggatgaagaaggtttgc

SEQ ID NO: 193371 - DNA, 19 bp, Artificial Sequence
  Description of Artificial Sequence: Synthetic probe
tttggatctggacgacttc

SEQ ID NO: 193372 - DNA, 15 bp, Artificial Sequence
  Description of Artificial Sequence: Synthetic oligonucleotide
caataagtagcctgt

SEQ ID NO: 193373 - DNA, 15 bp, Artificial Sequence
  Description of Artificial Sequence: Synthetic oligonucleotide
cacgctagtctgttg

SEQ ID NO: 193374 - DNA, 15 bp, Artificial Sequence
  Description of Artificial Sequence: Synthetic oligonucleotide
cttccttcctgtgtg

SEQ ID NO: 193375 - DNA, 15 bp, Artificial Sequence
  Description of Artificial Sequence: Synthetic oligonucleotide
caggctgagttaccg

SEQ ID NO: 193376 - DNA, 12 bp, Artificial Sequence
  Description of Artificial Sequence: Synthetic oligonucleotide
gctagtctgttg

SEQ ID NO: 193377 - DNA, 12 bp, Artificial Sequence
  Description of Artificial Sequence: Synthetic oligonucleotide
gtctgatggaga

SEQ ID NO: 193378 - DNA, 6 bp, Artificial Sequence
  Description of Artificial Sequence: Synthetic oligonucleotide
gctagt

SEQ ID NO: 193379 - DNA, 19 bp, Artificial Sequence
  Description of Artificial Sequence: Synthetic oligonucleotide
tgccatttggatctggacg

SEQ ID NO: 193380 - DNA, 2845 bp, homo sapiens
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttc

SEQ ID NO: 193381 - DNA, 81339 bp, homo sapiens
aggggacgcagcgaaaccggggcccgcgccaggccagccgggacggacgccgatgcccggggctgcgacggctgcaggtaggaggcccagggccggggggcggttcggctccgcgggcgggggctggagcgcagcgctgggcaggcacctgggctcgcagctccgaagctgggaggtgaggggagagcgatcggggacgagctgggacaaggcgacacaggggctccctcggagttggatcggcccctgggacttggcgctcgcgagaggctggagcggccagagtctagcctgcgaggagacgcgggtcctgccctcagcgccggccgcctttggcgccaaagacagccccgcaggggttccgggagggccctcctcctgctgtcccctctccaccccgggctccgagggccgttgggagggtaaccccgggaagaggccggggtgcggggcgcgggtgcaggtggaaatcgccagcaagctcctccccgcccgcgcgctccctccgacctgcagggctgtgccaatcccgaggcctcagcttccctgaggagccagggccaggcccccctctggacagggagaaggatctgggcgggggccttgacccatggagttggttactaagcggtttcgatggtttcccgagggacagctccctgtggctctgagtttgtctgtcgagggctcctggcctgtctccggagcggtcccaggtagagaaagcccgtgaagaaatggcccgggccggcctggagggagacacctcacgcccccttagctcctgggccgcctcctcctgcagcccctgcctttcccggggcttggacttggggagcgatgattacctttgctcagcttgtattttggcctggacgctaggagataagcccatgtagtatgcacacgtctgctacataaacaggggacagatagacgatcttcaaccagcaagggtgcagggaaaagcaatgcaccccaaacttctgaccagaggtcatttgcttccaaagatgctgccatctgtttattcactgtctggacatttggaaatggctcaggctcattaacacaatgctttggtttttgttgttttgttttttgttgctgtcattgctgtttatttgttcagccttagctctgggggaggagtaaacaaagcgcgtggcctctggcacttactgagcgctgagccacccctctttggatttattcggggaaagattaaaaagcatttcattaagaacaggacacggtgtttgaaatgttgccatatatgaatgtatgcattacgtatgtagtttttaaaataagataaaaagttggctgggcacggtagctcacgcctgtcatccctcacagcctttgggaggccaaggtgggtggatcacctgaggtcaggagttcgagaccagcctggccatcatggtgaaacccagtctctacttgaaatacaaaaattagctgggcatggtggcaggcacctgtactcccagctactcgggaggctgaggcacaagaattgcttgaacctgggatggagaggttgcagcgagctgatatcatgccactgcactccagcctgggcaacagagcaagactctgtctcaaaaaataagatgaaataagataaaagttggtgtcagaggctgcagtgtggcagctgcctattgtcaatcagaggtagcctggggtgaacggaaggcggacctgagcggggcttgtctatgcgcggcggccaccagagaatggctcgggatgtgagccctgccttgcagtccttctcgtgaaagctacagcgaacagtagctgtctccaaatcccgaaggccagtcgcatggagaagctggtctggcacagtggttaatggggtagtatggaagtcagaatgctggggttcaaatctcctcttccccatttactccagcaagtcacttaaccacttggagcctcaggttacccatctgcagagtcgggtaatagtagttcctgcctcagaggcttggagaacagtcagtgaggtgccgtccgaagggcttgggagagtgcctggcacccactcagtgtcctcacacatgatggcttcgggtcccaggtgctgttccagagctgggagagccaggagccctggggagagacccggctccttagtatctggtaggtatctccagggcaggagggatggcagtgaggcaggcatctgcccaaggcgtgggtggaagctgatggcatctgtcagaagtatgcactggggcaaggatgcctggtttagtatttatttatagggcatgccccacccaggtccaagaatggattgataacactgagcacgtgtgaaaggcacggctaaagtggagagaagagaagaggctgagggccgagagaggagccgcacacccactccagaacccggacgaggccctgcccttgcccagcggcggtattaaccctgagattccgagcacaccaaagtgacatcgcgtacacggtgaaccctgtgtttgcaaaaagtcagaaaaagtcttcaaaacatcctttaaggccaggcgccgtggcccacgcctgtaatctcagccctttgggaggccgaggtgggtggatcacttgagatcaggagttcaagaccagcctgggcaaaatggtgaaatcttgtccccaccaaaaatacaaaaattagccgggggtggtgtctggtgcctgtagtctcagctactcaggaggctgaggcaggagaatcgcttgaacttgggaggcagaggttgcagtgagccgagatcaccccactgcactccagcccgggcaacagagcgagactctgtctcaaaaaaacacgcaaaaaatacttttggtgtgtgtttcatgtaacgagctgccattttgcggcttgcctttgttttccagtgtggggagggctaaggcaaccttttaagatatctgtatgttatttcctcgtgattttgctttaaaagcaaaaaagaaaaaagctgagatgagttactaaatgacaataacgcctacttttcttttgaattcccgtgttatttgtatctgaatgtggtgaaagttttctaaatgtaatgttttatcaccagtaagtaggctgagtgatcacttactcctaccagtatttaatacttccatgttctgcccagattcctttaacaaatacacaaaacacacttgtagctggcaacatccactcgtgtataatgaaaacacacaatggctttcttagaagtttgccttcttaagtgggttacacaggatgcctcgaaaatccttctctgtgggtcgtgcagaaggtattttattctaaaaattccctctactcagccgggcgcagtggctcacgcctgtaatcccagcattttgggaggctgaggcgggtggatcacgaggtcaggagatcaagaccatcctggctaacacggtgaaaccccgtctctactaaaaatacaaaaaattagtcgggcgtggtgcgggcacctgtagtcccagctacccaggaggctgaggcaggagaatggcgtgaacccggaaggcggagcttgcagtgagctgagatcacgcactacactccagcctgggcgacagagcgagactacgtctcaaaaaaaaaaaaaaaaaatccctctgctcattggcatttgagtgtaagacagcttataccaaagtgggctcagacagacatatgcacatgtttacagactttctgcctgccccctggcagtccactctgtgctcagtatttctttgcaggctaaacactcgctcatccaaagtgctttcttttcctggacaagttgcacatcacagacccaaagaagaaaaagataatccagcccaactcttgttttttaatgtttcctgtaataactcacatttagcccatggtggctgtgagctggtacttggctaaaaagtttacatttttttccctgtaatccccacaatagcccgttgaagtagatactataattatgcccatttacagatgaggaaactgaggcttcaactggctattctacttgcacagggtcacacagctgcaaagtacgggagtggggactccagctatgaccacgaagctgggactggggctgccaaaccatcctttgcctgggtctgccgttggctcagacacggcccccagacacctaggaccgtggaacattcaggccggaagggcccttccagaacatctaagccaggggtagagagtccagggtgctgtgagcctggatggggaaaaatggcaccttgtattaacctcaaagcaaatttcagcatttcctctagttttgaatgtaggcagcaaactacagtcatagcagtacctgtgacctcaccagtgggaaccactgatattttcatggtgtccggtaatagctgcagcatcttaaaaagtggtttgtgcttgtcgctccgttgcaattatggcggtgattagatctgctctcaggcttacgacttaatgtatgaacaaagaagcgcacatatgatcacctcccagttttgctttttaaatattagggtcactttgtaagttttctcaggctgctgttacaaatgaccacaaattaagtggctggaaacaatagagagtgttgtctcacggttgtggaggcaggaatctgaagccaggtgtgggcagggtcgggttccctcggaggctctgagagggggctcgcctcctgtctccctcctaggatctgggggctgccggccatcctgtggttcccaggcatgcagatgcaccacccagtctctgccaccatcttgccatggccttctcctctgtgtccctgtgtgtctctccttttttgtcccttagatggacacctgtccttggatttcgggcccacctggaaaatccagaatgatcttatcttgagacccttacctaagtggcatctgcaaagaccctgattccaaataacatcccattctgaggctcgttcccagaggctgcatccaacccactagagtggctatgtttcagtaactcgtgatcctgtgtattttgcttcatgtatttaaaacattctcccggacaaggcgtctgagattccccaggctgccagaggggccatggcgcaaacggggaagaaacctggtctaagccacgcccctcttttcaggacgaggatcttggaacccggacactgaaggtcggggttgggcacagccggggatgggcagcccccctctcccccagcacctcccgcctggcgcctcctccacagcccctgcatcctggaaaacagactgttccacacactccagcagctcctctacctggggactgcttgggccgcatagcccccagttagggacagaaaccagaggtattgaacaagaagccccaccgggagaggcgagacccgggccccagccctggacctggccgtgggtgctacagaaggtcgggggacatcggtctgcgcggaagggtctggagaggcacctctcagggagttggacagagaggagacgccgtcccagtggtggcctccagtgaggcctggagagaccaggtggcaggaagggccctgctggggccagagcaagggcacggaaggcaggtctcatggagcagggaccgtggaggggacatgggggacacattagggatggacagtggccggaagattccgtgggccttggagattaaatcgggttccccaaagagcaagctgtggagaggggaagggaaagttgcctccctcttccctacggggttcttgtcaataaacgattgacaaaagacagactcacaagagacaacagttttaaggctgtgcccccgcccggaagtgccataaaaacaggagactcagcagtaaccagatgggagcggtgcagatgtccgtcctctgtgacagaaaggaaagggggcctgggcttctggggagcggtagagacaaatgaggagagggtgagggaggaaacgtctgggcataaaggctgcctcgtggtgcagctatcagtctcatggtgagaaaatgcgtcttggcgcgcggctctcttcctggcacacagaccattactaatgaaaatgtcctttatagatgtcaattttctttagaaaagagagttttttactttattttagggagctgaagagctttttttctgttggctggttctcagttgcttttagctcaaagtaatcaacatgtcaacatggcatattttggggtgacgtattctggtctcctacagtcatattttggggtgacgtattctggtctcctacagtcatattttggggtgacgtattctagtctcctacagtcatatttaggggtggcgtattctggtctcctacagtcatattttggggtggcgtattctggtctcctacagtcatattttggggtggcgtattctggtctcctacagtcatattttggggtgacgtattctggtctcctatagtcatatttaggggtggcgtattctggtctcctacagtcatactttggggtgatgtgtcctgagccccattgtttcctagtctgaaacttccccaagaagctccacggtacagaaactgggtgggtgtgttgtcccataatgctttgaagaggcatttctatggaaacaaaagaaaaaaaaaaaaagctaatcattggagctgactaaaaaccagtttctgagcctgggggccgtggcggggcaggtttgtagatgttgggctccgagcatcttctgcggtttggtctctggcgatgtctgggcggcccacgcagcaacaggcgtgagggtccctcgcacctgggcttcgtggtaatctcgctgatgagtatttcaagtcgtccagcctcagtttgcaggatttctgggcaaagggcagttttgttcttcgtgattccaataagaacggtgggagaaaattgaaagtgttagtttgggagttgcagccagatactggaggaaactagaaacatcaggaacccgtccagtttgtagacatcaatagataacaaaaccccaaagacgttaaacaggacaagaatctaatatggggcgcacaatatggctttctactgaaatatatgttctttctacatcacccctctttctactaaaaataatctcagtaagattattattattattattatttttgagacagagttccactccgtcgctcaaggctagagtgtagtggcatcatctcgactcactgcaaactctgcctcccgggttcaagtgattctcctgcctcagcctcctggagttacaggcatgcaccaccactaatttttgtattattattacttttttttagtagagacagggttttgccatgttggccaggctggtcttgaactcctgacctcacaggatccacccacttcggcctcccaaagtgctaggattacagacgtgagccactgtgcccagcctagtcagattaacttgtttgtaaagtaagtctagcctcattaaaattggcctgattatttgcacaagtgcagcaagaatagtaagtggccagctaggctttctttaggtcagctttgctggaacttttaataaatctcaggttaggctttcaaaagcctcttgaggctaagaagtcaagccaaggacttgatatcagacttcacctgcaatacctatagatttgggtggattcctctttctcaaggttcccaacgtattcttgagaattactgccaaaaaatcacagtctttcctcaacccgtgaggctgcagaagccctttaatccaggtacaagggcaattttgttttcctccaacgggtttcattggctccataaagtcaaccttagttccttaaagctactcacatctgattttatgcacatcactctcaaatatgatattccggtcaaacacttggtgagctaaccaacatttccagttgtttcctattacaaggcagcagattcatcttgaacttaagcaaataactctatggccgtaaaaataaaaatgctaatagtttctaaattctggagagatcaggtagggagaaaagtcatcatttcaattttgcttataaaagtgtaatgtaccagaatgctgtaagttataaatagtttcttcatttacattctggaaattcttgccatccagtggtgtgatcttaatgtatcagaaacctgtactggtcaaagtcttccccatgaaatcttctcgaagacacaacattttagaattatagttgcttgcaaaagctttcgggaaagcatcagagccaaacagttaactgtgtatgacagaaaggcttaaaatggccttggctaaagatgtgatgacatcattacaatgtaactgatgaggaagtttggttattcctgtggtgtatactttcacataataactagaattacaactaatatagaatgtatcagatttctaagaatttcatataatttctggaactcttatatgaatatatatccatgcaaatataactcacccagagaaggttaatcatcacttcatattttacagtgcttccatgcaaatttagttgatcaaataagcccaatttatttaatatctttttattttatctaaaacaattttccctttaacattggcaaaataatctatgtttttataaggagagaaaataaatccttttgagatattccaggggccaatctaggaaatcccaaacgttaattcagggtcaaaaagacttaatttagagtgtgtgattttggaaagttgtcaaaatgtcaaaaggttgaaagcacttgattaaatagaatcccagatcattatgaaataatacttaattctcatttaatcaaagtaacaatgaaatattcaaagagaaatgcagaaagttagatagtttaaaatactcttagatctggccaggcatggtgggtcatgcctgtaattccagcactttgagaggctgacatgagcggatcactagagcccaggagttcgagaccagcctgggcaacatggcaaaaccccgtctctaccaaaaatacaaaaattagccaggcatggtggcacatgcctgtaatctcagctactcgggaagctgagataggaggatcccttgaacccagggagattcatgccacagtgagctgagatcgcaccactgtactccagcctgagcaacaaactgtatatacacacacatgtattttgtgtatatatatatatatataatatgtattacatatatacatacactatatataatatgtattatatatatacatacactatatataatatatgtattatatatatacacgctatatatataatatatgtattatatatatacacacaatatatattttttattttattttttattttttattttttttaattagctgggtgtggtggtgcccacctgtctcccagctactcgggaggctgaggtggcaggatcccttgaagcccaggagttgaggctgcgatgaactatgatggtgccactgcactctagcctgggtgacagagtgagaccctgtctcaaaaaaaaaaagaactagttcacacccatgtttcctcctgctgccccaaattgccactctcctggagcagcccctgaaggtggagaccaggcacctgctggagcaggaactcttccttcaccggcttctgttggggccccaggatcctgcagctgtggcatccacagggagtaaggccagccacggaggtcctttcatgtcaccaagctgcaggggaggaaaagtgacatcagacagatcaacaggagaaaacccattttaatgatatgtccacgaatgggagtcccacacggagatgaaactgggggaaggggccagatggcggaggcgtctgcgtcatcctcagctgcaggaagatacaggactgtggggctgctgcaggctgaaccagctatagcaggggagttgactggtgaatgaaggtggtttcgtcacgcggacatgcgtctctcaggcgatcagagttacctggagccgctctcctcccggcatagagacctttacgaatggaaatgtctttcatttctctcccagacaggcagctgggcagagccactcctgtgtctgcagttactcgaaataatggatatacccaaggcatgtttggggtggcacattctgccccctcaagccatgttttggggtggggtggcgtgtcctgagccccaacccaggtgtcagggctatggaggggacattgcaagggggcctagaggggcctctatgggccttggagatggaatcagctccccaccaggccccaggacagacctggctggggagcgcagggaggggtccccagtgtgaggacagcatggggctgcctcttccagcagctccgagcgctctcagagaaaaacgaaattctcttttataagagaaacttgtctctggtcccatgtgttgccctttgggcactggcatgagtaatctgagggcggcgctttcctcactgcagtggcatcatacagatgagggctttgctgatcattatctggaaacagtgatcactgtcccattcacagatggggaggctgaagcctgggagatcaattcatgccaccaagatcagctgcaggccgggccacccatgcctgaggggagaaggggcctctcttcttcacgaggctggtggctgcggcacctacaaagacaggttaacaagaggaccctctgcctatcacgagcctggtggctgccgtaccagtaatgaaagacaagttaacaagagggccgtgcaggcttatttacgagaagttccatgtgacacaggagccttgagaatggaacacccatcgaaccggggaactctgcatattttcctcctgggtttgtggggtgtggacagcacggagcgtgatgaaaggatacaggcggctgggcgtggtggctcacgcctgtaatcccagcactttgggaggctgagtcgggcggatcactaggtcaggagatcgagactatactggctcacacggtgaaaccccatctctactaaaaaatacaaaaaattagccaggcgtggtggcgggcgcctgtagtcccagctactcgggaggctgaggcaggagaatggcgtgaaccaggaaggtggagcttgcagtgagccaagatcgtgcaacaatgcgagactccatctcaaaaaaaaaaaaaaagaaagaaagaaaggatacagacatcctgaaccgggggctggggccaggtctgaaggctctgatcttcctttcttctgggtctagggcacatgagggtctgtgacctaattcagaggaaggccagagaactcttttatggcctgcctcagggtgacagggagcaggagagagcatacctgctttccctggcttctcagatgccaccgtgccaggttttggggtagtggtatgtcttgagcccaatcagtaccctgggggtcgtggccggcccccctccctccatgccacaggctctctggagaggccactgctgtatccccactgtgagctcgatctgagctgcctatgggaccacacctgagaacccccaagggtggcactggcagacttgaggtgcccaagtgaggctggtgcagcccctctgccctgccagtctgggcacgggcccctgggcatcgcgactcctaccttcctaccagcccagatgcagggcctgagccggcagggcttccacccagcccagggtgtgtccccctaccagaggcgctgcattggataggaaggacccacctgtttccctgcccagtaccagctggcaggccccccgtggctcagggtgcctgtgaggaggggtgggggctctaattgctcacctgctgctctgaggtgtcaggcagggttgggggtggcacctggggaaggctgggctgagggggcaggctgcccctcctgcaggagaggtgcagtatttcactgggtcctttggaaagggcagggaagctcctgctcgcccgtactgcaccatttcctgtgatcttagcaatgacttcctggctccattttctccaccagtccgaatacatgagccagacccgcagctttctcttccacagcctcctggcctccgggtccacctgggtggtgcccacccgccagactggggcctggtggttgtaggggacggggagcagccttgcttcagtgtgggtcattcctgactgtgagatggttggggggcaggggttgtagagtctgtgggaggcctcggctgggcctcagagaggggtatctcttctgcagaaaacccagccacccttaccagatgcggtcaggctacaaagggaagatgtgctccctctttagaggcaggtgattcctgtgaatccgatgaccgagataaggtgcacgattcagtgggcaaggcaactcaccatcctctctttatggtcctcgcaatttgcaccatgcacaatgcagggtgaagtcagcccccaaattacagaggaaagactctgcggtctttgtcagttaaacaggagatgcaaactccaagctagttaatgagctgtgatcggccacgctcacgattcagtgcaggtctctccttcctgctatcacagtctttgccggctgcatcatgactaccaaccagtcccctcataattacaagagtctcctgtcatgttttcttctggagcgaggcatgctccaacttgcttctgggttcttaatttttgatcagggacggctccttgactaattatttggcagtaatgagggaggacagatcgagttgtgaaagtcccccccaagcttttagaaggaagctgcaaattaaaaaatgaggtattggtaaacaggatgctaattggattaatatgaaaatgatgaattctgataaaaatagcaaaatacaccgttgtaagattgaggccagtataactccaagaattcattgtctaatgttcagctggtcagtctggtctttgaaagtattagaataacagaaagagtctactcttgacgatgaagtatacggttagtaatttatgcaaaacagaactttaaaaccggaaggacttgatatgagtggggtgcatggaaatcattcgtattttgaagtttcataactctgacccctaggtcctttggtttgtctctcttttcttttttttttttttttagacaatttctctctctgtcacccaggctggagtgcagtggcatgatcttggctcactgaaacctccacctcccaggttcaagcgattctcctgcctcagcctcctgagtggctgggattacaggcatgaaccaccgtgcccggcctttttttttttttttttttttaagagacagaatcaccaggcaaggtggctcacacctgtaatcccagcactttgggaggccaaggcaggtggatcaccaggtcaggagtttgagaccaacctggccaacatacagtgaaaccccatctctactaaaaatacaaaaattagctgggtatagtaattccagctacttgggaggctgaggcaggagaatcgcttttgaagccaggaggcggagtttgtggtgagctgagatcgcaccattgtactccagcctgggcaacaagagcaaaactctgtctcaaaaaaaaaaaaaaaaaaaaaaaaaaagagagagagagagagagaatctcactctgcagcctaggctggtgtgcagtggtgcagtcacagctgaccacagcctccaactgctgggctcaggccatcctcttgcctgtgtcctgagtagctgtgaccatagacacacaccaccacatccagttaatttagttttgttgtttcttgcttttagagacagggtcttgctatgtatcccacactaatgaatgtaaaatcttaaaatggtgcctggtgcagagtaagctgtgtgttggtggggtgtaattatgggtcatattgacagtttcacttctgcggcatgccctcaggaactcactgatgcacacagagggacctgctggcaaatactgaagagctgtggggagaaaggaaggggtctgacagtgaaggtgggtgcgtgggcggggggcttttaatggtccctctgctggctccctccccaccacctcctgcccacctccctggccttggctgcaggctagggtgccctttgacctcaaagaggcctgtcctgtgtgtctcactgagcaggaacaaaccgtcccagaagcccttcagctcggaagtgagtaagcattggcggtggggatggtgctctgagcagacgcgactcagtgccatgcgggcgtctctcccagggcggctttcagactgacccccaaacagagggctcagaaaagatgtttttcaatgagggacatttatggttggcaaaaaaaagtggctccccaaaggtcttcacgtcccaatccccagaacccgtgtctatgttatttcccatggcaaaggggaccgtgattcagctattttgagatggggaggccatctggcaggatccaggtgggtccagtgtcatcagggggccccacaagaggggtgagagagggagctgatgatggaggcagaggttggagggatgcatttcagagatggaggaaagtgtcacatgccaaggaatatgcctgcggaagcaggagaggacggggaggtagggattgtcccagggcctccagaaccaagagaagacaggggagtagggattctcccagggccccccaaagacaggaagagggggaaatgtattctcccggggtctccagaagcagccagccctgcccgcagtttggctttagctccctggtacccatctcggactctgacctacagaactgtaagagagtaaatttatctcattctgtgctgctcattgtgtggtcattggttacggcagccacagaaaacagacagtgcgcacatccgcatggtcccctctccagctcttgcctgataggcataaacgagggcagctgggcgcggtggctcacgcttgcaatcccagcactttgggaggccgaggcgggtggatcatgaggtcagaagattgaaactatcctggcccacatggtgaaaccccgtttctactaaaaatacaaaaaattagccaggcgtggtggcacgtgcctgtagtcccagctattcaggaggctgaggcatgagaatcgcttgaacctgggaggcaaaggttgcagtgagccaagatggagccactgcactccagcctgggcgacagagagagattctgtctcaaaaaaaaaaaaaaagaaagaaaaaaagtaaaaaagaaaaaaaggaaataaacaagggcttgccctgtagttcacatctggaccacccagcttaaaatagggcaggggagttcaggaatagctttgcaacccttgtgttacggtgcacaggtgtgcaaaaattctccttgaactcccccttcagtgtccccccagggctcatggccactgtcactctgtgctagttgctcttcagaccagggaacagacttggccatggctatggccagggtccagctgctattgctcctcctgtcacccacccaccttttgtctccaacaaggatgttgagaggagccaggcaccagcctccctgggttcaggtctttcctctcccctcactttcctatgaactaggggtgggggaggaggagtgcctgccaggaggtcactgcagccaaggaacccaaattggtgtgcttgagaatgacccatggatacactttccaaagagtcacccggctgcgatgaggggccatctcccctcctggagccaacagccatgagtagctgtcacacacatccgtgcagcacctagacacacatccgtgctgtccactccgtgctgctgcaattgtgggggaggaaggtggcacagtggcagcgacacacacttccctctccaaaattggggcggggctcctcaaaatcctctgaccagcattaaagattcagaatttgatattatggctgcatataatgttgaattatctgaacttgctgcacgtgtgtgtgtgtgtgtgtgtgtgtgtgtgtgtattgttggtaggaccaaaacggttaattatcagcaatttcatggtttgacctaatattttaaaagagaggttcttacctgctggaagcatgtactggtgtattacggatgagacggtctcataggtggaatttgctgtgaaatgccccaggaaacaaaaagccagaggtcagagtgatgagagctggggacgggtggatgggttcctgggccgttccctgtagtgctgagtgtgcttggaagtgtccacaatgaggagtagaaacgagtacaaagctgggtggagacagccctgtcctggctgccctgagctcggccctgtcagtcgccttgaggagggttggggggagcagggatgcagggtggcgcgtgcatgccaggtggcaggcggcaggtgctggctccaggcccgtctccagccccagggctccaggccatgctccgcccccagctgccctgcagctccaggccggccacgctgccgcctagtttcgcaactccaatgtcatcacctaggtgacagggacgctgctgccaccgcccgcctgcgggagccaggagccagccgagggccacttccacctggccccaccgaccctccggggcccaggcttagccaaggtaggcttgggcttggctcgccctcctctcggcctgagtcggggggagtctccttgccaccgtgggtgcagtggctccgggggcccaccctggggtgcagagagcccctctacggcctcccaggaggcggcttggaaatgcagtactgttcaggccagggtggggaggccttgcccacagttctcctgatgggacaagccacagctctggggagccatctgccccaagtggcacatcagggctcctcgtgtgaccctaggatcgggggcagaagtggctctggtaccgccacctccaccccttggacccaccaggagctctttccacttcctgccaaggaggcgcagagtgactgccccagcctggcacgtccgggggcttcccggctgggggccgccatcctcagcctcacacagctgatccagaacctcccagttctccccagccccctcactcttttgtggccccggagcctctcccggcaacagcaagccatgccccggcctccccggcactcacgcagctactcccaagcctgaccatgacgtggacggcaggaaggggctgggcatgtcctgttccttctgcctgggtcctgcttccagggctggactcccaggctggggaatcctcagggacccatcaaactgggggacaggggaggggcttgtggggatttgctgtgaggagggcagagtgtgtacgtggcagtgcctgcggacacatgtgtgcgcatatgtgaataggtgtgtccatgtgcatgtatgtgcaagtgtgttgctagaggtgagagggtgggtagggaaactgagtgaccagctcctccctgaagccttgggggaatgtccgaggggccagggcctctggatcctgttcccttggctctttgcaaagtctccagcctggcctcctggatgggcatgtggctcggggggcgagaccatgggctcttcctggcttgctgtgtcgctctgggtgcgttttacaccactctgaggatctctctgctcatccctaaggcagggatgatgatggggccaggggaccacatgggcacaggtaaggcagggatgatgatggggccgggggaccacatgggcacaggcttctggaatgtgggtgtcgtctccctggggtcccgcagtctgaactcaagactcaagagccccatgtccaggtggggatgtacaggagccccttagaagtggggaagaaggccaggcgtggtggctcacatctgtaatcccagcactctgggaggctgaggcgggtggatcaacagaggtcaggagttcgagagcaacctggccaacatggtgaaccctgtctctactaaaaatacaaaaattagctgggcgtggtggcgcacacagctgtaatcccagctactggggaggctgagtcagaagaatcatttgaacctggaaggcggaggttgcagtgagctgagatcgtaccactgcactccagcctgggtgacagagcgagactctatctcaaaaaaaataaaataaaataaaaaagataggaaaagaaaaagaaaaagtgaggagaaatgaggaggaagtcgagcaatttaaccccaaatggtgcttctccagcagtcactctgttcctgtcctgacctgacctgctgggccccgcccgctcaaaccaaatcatggattctgtcatcgcttcttcacggagcacctactgtgtgccaggcgggtgctggggctgcagcgcagagagcagtcagggcttggtggtctggcccgcaaagagtcagcatgtgaatgtctctccatgcgatgggtgctgggagggaggagccctggcaggtctggggaagaccagcgtctcttaaatgggggtgcgcgggccctgaggagtgaggcttcctgacagccgtccctcgtgggtgccatgctggtcagagtggggtctggctgcacagcctccctcagggctgggctggaagcacaggtcggctggcacctgtccaggtttcagggttccagggctccagctggaactgcctcagggatggcaggggtgggcctgtccctggagaggcgtggggtgtgggagctgggagcgtgacgggaagcagccccctcagacctggagtagcatggagcctaggatccattgtgaccttggtggtcctgtaccctgtccagctccagttgctgttcctgcctctccctgacctactggctgcccaggctgccccttggccgagctccaccatggccagtgcccctccattcgcttgtgagtcccacaagatcacagccctgcccagggcctaggcagctcttgggctgacccagccatcgtcgggagcccccttcgtgacgggggcaaaggctggatcgttgtctgccctgcaggagccggggcctccagaggacgggctgcctggcgggaaggtggagctcaccggagcccagcctaagccagctgtggtgcttctgagatgtgcggccctgggcaggctgctcgccctctcggggcctctgggaacacctggggacttcccgctgggttcctctgaggattgaatgagcttgaaaatatggaggatttggcacagggaatgctgggcagcaatatcagaaaggcaaccctgagagccagcggacagccactctgaggaacagcagtggctgcctctggaaggagtgaggggtgggtggacccccgtgatcgctgcacgggggaggtcacggggctgagcggccaccactgtgcaggggaggtcacagggctgagcggctgactccagaacaggaagggaacacgccaggagggaggattgctcactgagtcagggcgggactcagagggacgcatgacaagttcagggagttgacagctgtctggaagggcacgtctgctcagaccgcagggtagggagtggtcagcagggagacatgtccactggtgcagcgggcgtgtcccagaccccttagagaaaagcccagagccaggggtgaggggtatgtgtagggtggggacatctcagagtggagcatccccaccaagggtgtccagaggagggtggccaggtggggacagcagcttgagaagggtcattctctcttggttggaggagtggaagtgcttctctggggaaagaaagaagattctggaggacagcacaggcacttccaacatgggcgctggccgcacaaaggctagtgacacccggtgtgatcccttggggtagaaagggggtgtgagaggaggatcggagggggcagaggacagggatgtgtctgtgcagaacgaggctgtggcagctccagcgaaggcggctgcggccccatcagtcacctgccctgctgagggcagcgctgtactcatcacctgtgaacacaggtatcgactcagacacccactctggccataagctccgctctgtcccagccctggacccctcaccccctatccttggcagtcggtcctctgggtcttcttcctgtgcccactgtgctggtctgaacctcccttagtgacagatctgctcctaccacccccgccagggtcgcccttcctctaacaggtgggctcctggcaggaaacatcaccaagctcagcgccccagttccctgacagggccccacttccctcctgccgccaacctcgtccccccaagggccatgtccctgcccaccccttccacccctttcttagaggaagctcagcccatcaggccgctcatgcttctgaccccacctccaaaccctcctgacccgcttacccccaggagcaccgcccactccaaggcgcaagcaagctggggctggggtgcagacttctcttccaccacccaccctcctcatacccagcctctgagggcctcacagacatacatgatttgcctccagtgggccagggttatctgtttaccgcgttgcatgcccccgggcatggagctggcaccggctgccgctgcaactgggcactacccgtttcgaggacgcctcattccctgagagactgaggataggctggtgctctgcaaaagggtgcggagaccactgtaaaagtggggtgagacacgcgtgctgaccatgaaatggagaggcactcgaaggagccagggacccggcagccagcagaccccacctttccgcccccgtgtgtgcagttctgtcgctcagcctggtgcctttgggacccgggcctcattggttcttcctccactgccaccacctgatactaaataaccgtcggtcaatggcaactcgatacggtttatggggcatccacggtgtgcccagatagaggagtgctttcgcttttgatatgcgtagagttacttcattccacctagcgcttctaggaggcactacaattatctccattttacagacaaggaaacagaggctcagaatgggcaagacatctatctgaggtcacacagctagagcgcggcagaggtgggctgcgtgggcagagcaggagagggaactggagtgtgtgcccggcagtgctgggcttcagggcacgaagcggtggggcaggaatcatgtgtcttggtatgacccaaacacatatatgacagcaagaaggcctgggcaggcagcagaggacaaggcgggcctcttggatgtctggatgtggattgggcctcaatgtaccggtgaagatagatggacaggcaggggatttccagagaggggcttcccaggcagggtgcggggtgtggctgtgcggtgggaacacggactggggaggggattgcagccgggcccgtgcctcccttgctcagctccaggtcaggccagggtagagccaggctgctgggttcgacctccaccctgaccagctgtgtgcccatggagggctggtcttccctctctgtgcatgtctcctggttggtaacaggtgtgtggcctcactgggccgtcgtggggtggctggaatccccgggaattagccatgctttggtgtttctacatttcacttggctgagtgtgaactgacccaggaagctggttgggggcacccccacccacggggggtcgggcattttggtttggtcatggcctcaaagcttctggggtgaggctcagggattcccccagactgtcctgggcatctgcctcccctcccctcccgcttcccgtgggccacggcccaggagagagagggcagcttgctcaggcacctccagctgtccgcatatttcacacggtgcacgctaccccaccgtgggaggctgtgtttgtctttcatccccatgctgggcttccccaaactaggggagtggggcagcaggcgtgccatctgtggcggtgaggggggctctcagccgcatcctcctcaccaggccctgcggacaggccttcgtccctgcccctgacctgctgacgaagccgtcctggcaaccctgtctgaaggacctggccccatcgtacccacagagggaggccacatggtccttagcctctgtcgggaggggcaggcaatgctggcagagggccttgcccctgagagggaggccctcctggccctcactccgggggacccctgtccttggccccagcctgccaagcgagagcggcccctcttcttgcggtggctggaggggagagtgaggccccttggcacagagggccccaggaggctgggctctgatgacgccctgcaggaattccgctgggctgctgcctgggagagccgctgtctcacacagggccagcctgcctggcttcattctggtgcgctgaccgcccgacccctctgcccaggcgggggctcttctgggttctgggtcctgggacctgcctgagtccctgggaaaagggcacaaggggattgagacggtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggcccaggtgtctcctcccacaatggccccaggtttctttgccacttcagattggaatcgttgatctgctgaaataacaggtaaaatcattggtggtttgggaaccaccggaatcagaagtgcattgagatgtttgctttaggggtggcccggggcgggtggagttcctgggggcttttccctcctccctgaatggaggaggacaccctgcacccctcctgtgatcccccttaagagccagtgtccgggatggctgggccagacggggcagaggggcctgtgtctcctgcccaggctgagtgcggacggctcggtctcagagctccaccgaggggtgggtaggtaacagcagccctgcggccagggcccctgcaggtgggagtgggtgtccccatggggagtgcctcttccagagtgggctcagtcggggtggagtgtcctggcttatcaaaggtggttgtggagccctgtctgccccaggcctgggcagaggtggaaggggttggggaactgacgaggccttacctgtgggcccatggccaaggaaatgtctggtctcccacctcctgtcaggtggtgaggggagaggatggggcgtcagccggagacggggttcctagaggaggctgggtcctggcctggcctggagagatagggatgagatgggagggcaggaagggggtggtagacaaaggctgaacacagagagcacatagccaggcatgtggggactggggacaggggacaaggagggcacccatggggacaagagatagggagaggacagagggacaggagacggggagggacagaggatgggggacaaggaggggacaggaggacggggacagggaggggacacagaaacaggagctaggacggggacagaggatgggagaaggagaggtcaaagggacagggaacagggaggggacccatggggatagggcagggatctatggggacaagggacagggaggggacagagaaacaggagatggggaggggacagagggatgcagacagggaggggatagaagatggggggctaggggacaaagggaaaggggacagggaaggaacctatgggggacagggagacagggggacagggagaggacagaggaacaggggacagggaggggatgcttggggacagggagggaatgcttgggacagggcagggggacagggggctgtggctttcgtgggaagctatggaagacgaggccagaggggttgggcagggtgagatgagagaggctgagagcccctcaccggctgcggactcctccccacagggcagaggggagcattcgggtgcggccaggccatcagaggacctgggcttggctggagtcccagctcctcagccctcagtagctttgggccagccactgggcctcctggcctccacttgctcatctctgaactggggcagggttggcgtgtgagcctgaggccctgcaaagtgcctggccagcctcagctcggagccatggcacagcaccccctctccgccacggccccgacagctgggcgtgcgttctgctgtgggcagctgccctgagcaacgtagggtgctaagcagcatccctgtcttgcacactagattccacagcaccctctgaccccgtggaaaatgtccccacatgggaatatcctctgggggtggaactgcccctggtgagaacccctaggctgagacctcagaaggccctgagtcaaaccgagaagtcatcagagagccttgttttcagctccagggagcttgggcaggctggttttctgggccacacagtcccctccccagcccacctgtgctccgtgggtcccggggaagctgtgggggcctaattgctggtgtgagttcctttcctgttctgagtcacacgtgtgtgggggctctccctgtggtgcagctggtacagcggcccctggagttgaggatccaagcaggctgaggtctgggtttgccggagggccctcggtggctggtctttgtcctgctcccactgctgtgggcactgtaggacttggaacgctggtcacctttccagcctggcaaagggaggggacttgtctgaggcctcatggaagttggggcagggtcgaggtgccctgcttcctgggtgtgccagcagcctacagcctggctacagcgtaaccaggaacacccagcacaactgtcctttgcaactctgtgccctgacttgatggtgccagggctgggggggtgccggccagcagctccccaatgaccacccccaaatgctgtggccacacaaagccttccactgcaagacctgtggtaatacacactggacgcccctgttacaactgagaactcatttatttcatttccttccttcccttttttttttttttttttttagagttgtggtctagctctgttgcccagactggagtgcagtggtgcaatcatggctcactgcagcctcgagcccctgggctcaagtgattctcccacctcagcaccctgcgtggtttggactgcaggcacatgccatcacgccctcatgcccagctaatatttttttaagtttttggagagctgaggtctccctgtgttgcccaggctggtctcaagcccttgggctcaagtaatcctccctccttggcctcctaaagtgttgggattacagttatgaaccactgcacccagcccatccctcctagactaaatcttcttagaaaaacctacacttccaataatgtatttgcattttatgatgttgataaaacttcctaaagatgtcttatgaaattggtctcctttccccattgatacacatgatttttaaaactattggcaacgtttcaaaagcaatttctgttttgtcccagaaccgtgatccccttgtgaacgaattttcaaattaaaaggcaaatggttgggaaaattggatttaattgaaaggccattttattagaattgacttatttttctcgccactgggatccttgcctgaaaggcggctgtgggcagagggcacatactccccctgccccagcgcagcgtccctgcacccccaacagagcttcctgttcctcatgcccagtactcccagatgcctgcggagccagtcatcagctcaggtgtgtgaggccggttgggggagcccctgcctggcgcctgtgcctgtgagcagtgttcctgtggggccctgggaccaatgctaccagcgttggcgttttcccaggaagttgggaatcaggcatctcgtggcttccggttcaagttcctccgtgtgctttaagtctgggcaggtttccgggtcctggttttggctaatgaggaacccgattcccatgggggaggccggtggctgcagcagggccccgagcagtggcaaggctggccctcatgacagtgtcctcctcagggggcctgtcccaggctcttcatgactcccctggaggcttgttaaaggggcagattcctgggccctgccccagccccactgtggggaggggtgtcctggaagatgcatctgcccagggcttccggctggtccacacgcctgcacctggaggcccactgcccacatctcaggcaaacaggcctggggatgtttggggacccaactcctggcgtggaggaagcccctttcccaccccacatgctcctggtggtggcctgtcctgtgagcctggagggccggacgggtgggatcggggacccacgaccacgctcgctggcctctgtcctgtgcccaggcagggatgagaggccaagctggtgtcctgcagtgcacagtgggtgccggtcaggggatgtggaagctgggtctccggcaggcagaggcgcgctgacaagaagggtcgctgttcctcattcagggttcagtgggaagagagggtgtcgcttcagggggagttcacaggatgccgacttgaaaatacagccaacgcccatgtcccaggcataagatcacaaatcatgttttgccgaccagttcctgtgagccctgagccctgcgcggagggatgccccgtgcacacctgttcacggaacccctggacctccagtaggggtgcggcgggatgccgtcggctcccacgctgtctgtctccctgtccctctctctttccctctgtttctctgtctgtctctgtctgtctctgtctccctgtctctctccatctctctctgtctctctccctgtctctctgtctctgtctctctccatctctctgtctctctttgtccttgtctctccctgtctctgtctctctcactctctgtctctctttgtccttgtctctctgttttgtctctctttgtccctgtctctctgtctctgtctctctctctctttgtccttgtatctctctgtctctctttgtccctgtctctctctgcctttgtctctctccgtctctctttgtccctgtctctctctgcctttgtctctctccgtctctctttgtccttgtctctctgttttgtctctctttgtccctgtctctctgtctctgtctctgtctctctttgtccttgtatctctctgtctctctttgtccctgtctctctctgcctttgtctctctccgtctctctgtctctcttcctgtctctctctatctctttccctgtctctttctgtctctctttgtctctctctttgtccctgtctctctgtctctcttcctgtctttctctttctttgtccttgtctctctctctctgtctctctcttcctgtctctatccctgtctctatgtctctgtctctctttgtccttgtttctctctgtctctctgtctctgtctctctctgtctttgtcccaccttagccttgggaggggacagctcacaggctgacagatgaggtcatgtgtcctgagcatgaggttttcaggtctcacccacgctgtagcatgtcagagcttcgttccttttcatggccgcgtaatgttccattgcttgctggcaccacatctcctgtgcccggccctctgctgatgggcgtctgggctatgtgcaccgttcagctaccaggaatggtgctgctgtgaagggagctgggattttgtcatccacctgctgtggatggcaagtccatttccatctctggactcaggtggcccatctacaaaatgaaggggatgcgacccagaggcctctggcggcaaaaccttcccaggcttgtcctcttggatctaagggaatttctttcctccgagtccagcccctccagtgctcctgcccttcaggaaacatgcctgggacccctcacttgtgcccacccagccttggcccacatacctgcaccaagaggctaccctactcatactgctcagcccaaagggacccaccgtggggtatgggcaagggcgggttctgctctcccccggggccctgtgccagcctcagctggacctgcggttctgcttcctgtcacactctcccattttaaattaacggaatggtgcggtccccatgcacaccctcagctccactggggttttagcccagcccaggatcggaggcctgcaagggcacacccacctggccacgtgatggtgaagtggggtggggcagggcaaccaaattaacttctaattctaagagcccctggagcattcatcaccagcacttacagccgtgtgacctcacacaagtcacttaacccctctgagccttggggctcctgaaaagtggatggagcggtcacgcccacctgggagaggtggcttgggccagcaccctctaagctgcttgtcccaggccatcatggctcacggaccgcccctcagcctggcctgtgccacttctccagggcccggcacgtggcagccacaggcttctatcagctcccgcctgcctggggaaggacaaaaacgacaggttccaggccatggcctgcacccccgctggccgtgggcaggtccaggcctgcctgcctgagcattgcagggcggtggccaagcctgtcccatagcacctcaccgaggacctgggaggctggcccaggggagaggtcacctcagccggggctgggggctgtgggcagggtgggctcgggtttccctgtcccctcccccagctgtgctctgcctggacactgccacctcctcatgggtgtccagggccactgggagctgggcccaggggttctcaggggagcaatggtggagacaaagaccagcggacgggcgctggggtcagagctctccaatccctgggtgtctccttctcaaggcgtgaccacccaggcagtggccggctgcaggacagggcagcttcaagttcccagccttgccaggcttccctgtggccctggggtgcaggaaggagccccagctcagaaggcgagggggcgtctgtgtcctgcagcagtgggcacagctaggctctagccgggggcttggctgcagcctccagcgcagccctcacacacgctgttcccaagatggggtgaccgggaccggagccacctccaggtcccgggcatcagggagaccccaaacctggctgcatcccccaggccaaacccagacacaggggatcgtaacagaccacaggcctcacacacttgttccggcccaagcatcccccaggccaaacctagacacagtggatcataacagaccacaggcctcacacgcttgtcccggcccaagcatctcaaagagtctgctctcctgaaggccctcaaggcagccccaggagcgggtgttgctgtcaccccctcttccaaggcgacggctctgagaagctcctgcctgcccagggcacccccacggatgggtctgatccaggcccgccacctccaaggcagagctgcccacctggccttcggtttccagccgcggggaacagggtggacgaaatgacagtggagagggcacagggagggcaaggcgggggcacctgctccagggatgccccaggcaggcccacttgcctgccgcccccaccgaggctgtcacaggaggacagagcacgagttcccagggtgctcaggtgtcattccttccttcctgcagagcgagctgccctcggaggccggcgtggggaagatggcccagtccaccgccacctcccctgatgggggcaccacgtttgagcacctctggagctctctgtgagtgcgcttggctggccagagctgggggcccccctgggaggcactctgggctagcctcagccaccttcgctgggctaactgggccagagcaggaggggtggccccgggaggactctgggctagccccagccaccctcactgagactttgggctaaacttggcaaccctcactgggattctgggctagcctcgaccacccttgctgcactaactggaccagagcaggagaggtggctccacactagtcttgggctagccttagccaccctcatcagcttggggacagggcgggtcggaggggcagggaagagggactgctgccctaggccttccctggggatgcaggaccaaaattcagactcttttctctggccagctctggagagggcccatggccagcagaggcccagaataacagagcccatgactggctctgcctctctggcactcacagcagccctggaatggcaggtggaggacagagatgggatgagagggaatgggaagggcaggagacgtaggcctcaccaggagtctcaggctagccttgagctctgggcctgggaggtattggggtgacacccaaactggggactgacgcttctattttcctctccctgccccagggaaccagacagcacctacttcgaccttccccagtcaagccgggggaataatgaggtggtgggcggaacggattccagcatggacgtcttccacctggagggcatgactacatctgtcatggtgagtgggggggctgccctctgcaagaggactggagtggggacaacaaatgtggcctgtcctgtcttgggagcctggcagaaccaggagatagcctcttggttgtacagcttcccctgtgggtttctgaggacacttcaaattgcaaaggagaaaatgtatcagctcatgtaactgtcaatccagagataggaatggattcaggcatggctggatccaggtgtaggaagggcttcaggcatggctagatccaggtgtaggaagggcttcaggcacagctagatccagatgtaggaagggctttggacatgggtgggtccaggtgtaggaagggcttctactggtggatccaggtatagaaagggctttgggcatggctgtgtccaggtgcttcacagctgcctcgctcagtctcttggtctgctttcccctgcagtgactttgtttttaggccgcatctcctctcatggtgaagagtaccaggctccaccagcatgccctatccctgtggagaggagatccctcttttcccatagtccagcagtcctgcctcccgttgatctgaatgtggtcatgggcccatctctgagccacatctgtgcctctgattggcctggcctccaccatcagtggaacagggtgacaatggaatggagtggggtgggcctccccacacagggacccccaaaggaagatggaggtgctgtttccaggagaagaggactggatagggggcaggcagggccagtgaggcctccggcaccccatcttggcaggctcccccattcctgggagtctcaagccctgccccattggctgctcctctgggggaaaaggccaggctgtgggagctggtgggggccacgctcctgcctacctctctggctgcccatagccaggcctcgactgtgccgggaggtggatggcaggtgggcaccacacgtgaggagagagcaaagatcccgacctgggaggcccagcgaggccagccgtccccgctggactcgtcagctgctcggccccgcccacaggctggctgccccgccccgcctccgccgcccagggattcgtaggtggggaatttgtttgcgctgcggaaaaccagcccgaactgtggggatacgcggaacagcgcgtctggggcagggtcgggcctccctcacttatgctcagcccgaaagggagggaggcgatgctgggcctctgggggcctgagagcacccggcctggccctcctcctccctcaagtccccattccaggagctggagccccttccttgcccctgcgcacgactgactgtctgaggcatgggggtgggcggcccagccaccctgagcactggagggagtgggggctgtggggctccagtcagaacgaacagagtgaagcggggtgggggagtgtagaggtggaggggccgtgttgcctgttccgtctccattgcggatgctgggctggcccagagccatgtggggccagagaaggcacctccttgggcagccacagtcccggggggtcaattcctccgaggagcccctcagcctgtatctgagggttcgaccgcctgcccctgccctcccacccctgctcaggagaccgtcccagtggaaacactcgacagtgtctgcgcgtgttctagtcccgtgttatgggtgaggaaaccgaggcagatgctgggaaagggtgggctggggatggggccgggtagtgcaagaaagtgagactgcaacctctcccctctctcgctttggaacagttctgccggctgctctctggggacaagggtcctgaccccaccccctccaggtccccttctggacatccgtgtcctccaatctggggaggggcaggaactggccgctggaccccagggagggagggaggaagacccataagattgtcccctgagatccagaagccacctcccaaccccaagttgctcagccactccccctgcagagggcagaaggcccctaagatggcacagacccaccctgtgtcgggaggaggacctggactcagggaggcagaaggagcagttctacattcctgagtgggtggagcgtgcttgtcctccccagccccggagggttccctgagctccatatcggggtctggtccgagcccccgcctgctggaacgtgccactccccagccacagggtgacagtgggagcctcgaacctccgcaaacagcaaggtggctggatctgtctggcagcgacacgcctcctcccaaagccatgtatgaaattcctaggtgcacagctcgactcacggagatgggggattccctggaatgaaggcaggcccaggcctgcgtggggagagccaagcctcattctgaccccagggcccagccccctcacaacagtggctgctgggccaagagcatgctgtcccctacccctgactcccatgggagcgccaggtacaaagacagagactccgaagggcgccaacgggtgggctcgggcagcctggcacagggcccagggcttagctgccttgagaatggcccctggcccgctaactccaggggtcccagagtggggctggagctgaactggggggcattgttttaaagttcagcccaggagctcagggaagctgctgtgctggggctggggacctggacccggttcagtgcggatgcgggcatggggggctctgagtgccccctggaaaactgccacctgcagctcaggggcccagttctagccccaccacgaggctggtgaccttggacaagaaacaccacacaggcccggcctcgggtcagacaggcggttctagtgccggatgtttccggggctaccgatagtcctgagttcgtggctcaggtggggggcctgcttgtggaagtggctgcacacgcacctgcccccacctgcccctggcggctccctctggccacctgtccctgggtgttggtggcatctggctgctcccatactcaggggcgggtctgggactcatccagcaaaggggcctcagctcgggcaggcacagtgcttgagcgcaggacactggtcctctgcagtggggcgtgccttccgcatctgggggacgtgggtctccccgaaccacgagcaggcagattggttcccgttggacacagggtgtctgagggatgccttagccacctgcttagcagccgtgggagacaggcggagcaggtggtttcaagctcccacaattctctgagcctccatgtccttgctggtgaagctggggtgacagggggtaggagcccagagcagagagccctttgggaggtggcatagactctgggatgccaggtgctgggtgctggctctgcccaaccccgtgggcctcggacaaccctcctgccacactggcccctgcagaggaggctgagtttaggcagttcaggagagtggggtgtgggcaagagcagttgaaccctcagtgggctctagaggagtcccaggccacagacttattggggagactgtgagctctgtgtggccatagcaggaaacagaccccgtggtcactgtggccatctgactgaggtggcccagaaagtccagcaggccgaggtgggtgtggctgggggctccgaggccaggtttgctgagctcaggacctaccccttcccttctgagctgggcaacttttaaagaattacatagccctctgggcctcagtttcctgtctataaatggcgctactgagaggctccaagtcacccacgatgtgaggatgtccagtggtgccgggcccatcgggagtatgtgacaaacgctaggtgtgagggtgagggcagggaggaggccctgtgtttaagaaagctgctcctcggacaccagaacagcagagccaggagggcctaggataggatctgggaccagggcctgctgcctttgcctggcacagttcctgcctgagctgtcccgtgccttaggctctggctgtccctgaagaccctacatggctcacagggacctcactctaaaatagggccccgttctgcaagaggagagcagggggaagcctgtggcccgggcctccccatgggctggggagggtgggccgaggagccacagctaaaactggcccagcccctgccctctcaggaccctggctggttccctgaatgaggaaggcttgacgggcttctggatgccacctgggtggggtctgccctggccacccccacaccgtctgggaagagctgcagaggataaagctccctcgtaggctcgcaggctgcgaggaggcagtgtgggtgtgatggtggggcgggggtcctatcctcacccggacccacccgaggagtctctgcagtgctgggcctgggcttggaagcgaatccctgcccctctgagcgctagcgtcccctcggacaaaaccagcgcagggcaatgagacctgcggcccttgctggctctcaggatgctccacaaggagggaggacacaggaggggagaaaaggagagagaggcaagtgtctcctccctcccctcccctccactctgctccgctcccgtcctctcccctcccctctctgtccctagagcctcctccagggctggcccctcccctgtgccccttcctgcctctcctggcgcctttctctgacaacaggtgttgtgggcaggtgggccacagagcggggtctacagctggtggggcagaaggcaggctgatctaccctgggagccccgggaacccagtggcaggacagacacccggggtcagaaccttcggacacttgggggcttgagaccctagaggtcaccccagataggccttggtgacttcagggagaggtattctccccaggcccaggagaaggaagggcgcaggtcccgtgcatgtgtggcccccaggaaagggcaggcggacagagggagaaggacacccctcccttccagggaggatctgtagctggaggaagggtggggtcatgcgtgggagcagggagggggctcagctcaccacggtcagctctgagactccagcccacccgttaccccctcccagagagcccccactcagcctttcctttggtgggctttcgtgacaaagcactttggggctgcacagaagtgaaccccacccagcacccaggtctcagagccttgcagcttctgcggcctcttccatgcggtgggatgaagccagctgcccagcagggaccctgtgccatgagtttggccttgaactgacacatcactggcaccaggaaacgaagtccccctgtctgttctggcacataacccctcccactaactggttcctgaagagtgccgtggcctgcggcagcgtcgttcccccctgtcctgcggcccagggtcctgcggaaagtcaggcggaatccccggtgagtcagaagcagaatgaaagcagaatggaggacccagcagggagggaacctggaggaggcgctaagggccacgccaagggggtgtggccccagatcccctgtccctgtcctctgcaaggctgggccttgggaacgtttgcagaaagctgggtgccgctctggggcagaggccagtggttttgggtgcttttgagttggaaacgtgtagctcagccgcactgggatccccgcagcctggcccagatgctaagggtggagagatgcggggtctcaggcacggtgccctgggcatgggtggggctcgtgctgaaggcagcctggctgtcttccttcctcacgtccttccacttggcgctctccttttggctatttataaaaccatcaggccggccctgtgcatgggactcgcctgagtctccttttcaatgcatcattccctttggcaggagaggacaccgcctacagaggctgaggatgtgccctgtgggggtcgggagcggaacccaggccccgcctcggccctgctctgagggtctgtccatccctggggagcccgcccccaacccaagaggggtcccaggctcagaagcagaaggcaccctcatccccagggcatccccgatcccagcaggagtctcctagtgctcgccctgggctctcctgcaaggaggctgctgctttccccagaacatccagtctgggccccagccgaccccctgcagggggcttcccagagacgcccttcctgaacctgatctaccagacaaaactgtctttttctcagtcgtctcctcctgagtgctgctgcccttcctgttgggggctgagatcctctgccacaggaagagacgggcgtccaggactcacctgctgcctcccggccctagggccctgagctgggctctccaggccccagccccttggggcacaacacctggaatcgtcctttcgtcctcagcccggcctgctggtggggcagggcgggtccccagggctcctcaggcagctgcagtccaaacctcccctgccctcacccagctctgcccgctctcccgggggtgggggtggggagcgatgaggcccctgccggctctcggtggggacgacagggaggaaggaagctggggagatggagacaagagaaagcaggcaggtggtttgggatttggcaggaaaaggttggaaggaaaggggaaagggtctccgcatggatttctcagctccccatggatttctcagccctcgtgagagccacggcgccctggggactggaagtgtgggtccgcaggccccagtccccaggtttgtctgagcatagatgccctgcctgcttccagggggactcgggcccctctgccagggtcaactttgtacccaagacggctgaaatacaatggaaattcagacggcccaacagggagtggcagtcacctcaaaggccccactagacgggtgcggggcaccactgcagagcccctccctggctgtgccaaggccgtccacgcctgcagggggccccactgccgggctgttctttggcaacagtggcttgtccctgtttcctgggggcttggccagtgccagggtgggctccaaacgcacggctctgggctcttggactcacccctgctttgggcaggcagtggaaggcaggccccacaagagctgctcactcccgtcacctgtctccctcgggggtctagggtcgaacctcctgtgagcccctcctctccatgcagcccttggactggtcctggcggaccaccgagttccccgcgcagggggcaggtgcgccccacctgggtgccaagggaggcgacaccatctctcccccttggggtggcccagccttgcctaccatgatctccagggccggggctcagccctcatgcctgggaacagaggctgctttacggggtgagggcctggggccccccgagccttccccaggcaggcagcatctcggaaggagccctggtgggtttaattatggagccggcgctgaccggcgtccccgccctccccacgcagcctccttggtgcggtccaacacatcaccgggcaagctgaggcctgccccggacttggatgaatactcatgaggaataaaggggtgggccgcgggttttgttgttggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggtaggtgtgacgcgccattcataggatctcttcggggactttgcgggggattttgctgcagtgtagggttcagaggggcatccttctgcctgccttcctggcctggagtctgctgccagttggggtgagcagaggtaggaagggaggcgttgaggggctagaggcaggtcccaggcatggaggcaagcagattcgggctccaacagcctgtgcccacctgctgggcagggacccgcagccagggagaggaggccgggtccatgccgatggggctgctggtgtttctgcctcgtgctcgggggtctctgatgctccttggctttggggctggcggcttggtccaggctcagagtttccgagctgccctgccctgccccagctgccaggagctcagtgcaccctagaagtcatctttgctcctgggcttgggtgtgaagctgcccccgccctcatcagggaatttgctcatttgacagcagtggcagacggtgcttcttgtcagccccacgggctcttctcggtgtgggtctgagctccagggccaggacctgtggcaaactgggcttgaggcctcttgcgccacccgccccctgcagtgggctgctggcttggaagaggggagggaagggtctgcagcttgtggttggcccctgcagcctgagccctggggacctggcctcacttccagacttgccaggtccctgggggccaggcaggcaccagctgctaattgagaaggtggaaggctcggcacagctgctccacgtggggccgttcctcctcccagggaagcagacagctgggaccatgggtacctgtgccacacgggaaactcagccatgggcagggggcagcgggcagataggcagagtccaagtgccccgaagctctgctggcactgggatgtagaggcccaaagatctggggacggaggcctttggagccgtgggctccccaggcagtgtgaccagggtgtgtgtgacagcgatgtgtgtgagcgtgcacatcaatgtgcatgtggcgggtgggtattggtgtgcgtgcatgtgtgtgtctaagcgtggatgtgcatgcaatacgcaggcgaggatatgtgcagatgtgtgtgtgtatgttatgggtgtgtgtacaggctggtgtgtgtgtatgtacacgtgtttgcctgtgtgttgtggtgtgtgtacgtgtgagcagattggtactgcaggtgtgattgtgtgatttgggtgggtaggtgctcacgtgtgtccgtatgtgtgttgcgatggatacatggatgtctgtgcctgtagctgtgtgttcccaggcaaggctttgagaagagaggcagtgtgtgtgtgtggcccagagggtgggtgagggtgtgggtgacccagccccacagcctgcccagatgctgggtccatgcactcgagtctggcggcaccatggcctctccacacgcctgcgtgatctttttatctgaaacccagtgctgggactgtagcccagagcgtggaacggctacatcaggcatggggtgtccctctctcccttgtctggctgtcacccacttgtgcattgatacatgtatccaccaacacgttgctattagaaacgcacagcaggcctggggctcctggggggctgccttgtacccccagactctcccaggaggtgtgtgagctgggaggggctatctcccggctgctggaccgcctggaacccgaggtggatccagaagcctcgggtggagaggccagtgtcgctgcctggccagccgagaagcctggggacctgggggactctagtacaatcttttcccttgaatggagcagatgtcaccatgtgactcaccctctcgggggactccaccaaggttgagtatgtggttgcgcagacgccattcccgggaggggtggggaggtggagccctgctgccctggcctgcagaccctcactgcctgcaggagctgctggtgtccactcggctgctgctgcccggtgccctgggcgtcagcaatggccagctgtgccatcactgtttctttttacaccaaggattactgtggttcgttcgttcatttgtccattcattcatcccatcagcaagtgttaactgggcacgttttgtgtgttaggctgagtgccaggagcaggtggaggcagtgcccagagccagccatgtctccagcacctcttccctctcggggggaggtgggctaggctgggccatcctaatgggcggagtggtgactcagtttccctgtttctgtgccagagagagtattcatgacctcatcttactgcaggaacgtattttgagagagaaagtggtatttggcccaaagggttttaaacccaaagtgagcgaatagagttgtattggagttggtggctttgtgaggccctggttattcctatcaaagcacagtagctgctccggagcccgctgggccagcctggccctgggaagaggcccctgggttgcaggacactgtctgagcccccagctgggcccgccaattgcccccagcctggcacagggttccaggtgtgggcttggggtctgtctctctggcatctgccagctgagtctttggtcagtgacgccgctctctgagcctcagtctcctctatgatgaggacggtgttcaccgtagctgctcggctgcggggcccaatgggagccactggttacttgctgcagatggggacgcaggggggcctggcctggagagctgccgcctcagcccctcctcccacaatcccacccatgcagccttagcccctcctcctgcaatcccagccctgcagcctcagctcctcctcccacaatcccacccatgcagcctcagcccctcctcccgcaatcccagccctgcagcctcagcccctcctcccgcaatcccagccatgcagcctcagctcctcctcccacaatcccacccatgcagcctccgcccctcctcccgcaatcccagccctgcagcctcagccccctcctcccgcaatcccagccatgcagcctcagcccctcctcccgcaatcccagccctgcagcctcagcccctcctcccgcaatcccagccatgcagcctcagcccctcctcccgcaatcccagccatgcagcctcagcccctcctcccgcaatcccagccctgcattctcagcccctcctcccgcaatcccagccatgcagcctcagcccctcctcccgcaatcccagccctgcagcctcagccccctcctcccgcaatcccacccatgcagcctcagcccctcctcccgcaatcccagccctgcagcctcagccccctcctcccacaatcccacccatgcagcctcagcccctcctcccgcaatcccagccatgcagcctcagccccctcctcccgcaatcccacccatgcagcctccgcccctcctcccgcaatcccagccatgcagcctcagcccctcctcccgcaatcccagccctgcagcctcagcccctcctcccgcaatcccagccatgcagcctcagcccctcctcccgcaatcccagccatgcagcctcagcccctcctcccgcaatcccagccctgcagcctcagcccctcctcccgcaatcccagccatgcagcctcagcccctcctcccgcaatcccagccatgcagcctcagcccctcctcccgcaatcccagccctgcagcctcagcccctcctcccgcaatcccacccatgcagcctcagcccctcctcccgcaatcccacccatgcagcctcagcccctcctcctgcaatcccagccatgcagcctcagcccctcctcccgcaatcccagccatgcagcctcagcccctcctcctgcaatcccagccatgcagcctcagacccttcctcccacaatcccacccatgcagcctcagcccctcctcctgcaatcccagccatgcagcctcagcccctcctcctgcaatcccacccatgcatcttcagcccctcctcccgcaatcccagccctgcagcctcagcccctcctcctgcaatcccagccatgcagcctcagcccctcctcccgcaatcccagccatgctcttcacttgcttcccacactgtccttccacatgggggactggataatcctgtggtggctctggccaaacaaggccacgttctgagtctgcggctcccacggactggggttgatcaatgcccaaccccgaggtggacacagagacattacccacttctgcctgtagcaaggaaggagccgatggctggatgagtggggcccctctagaagaggctgagcgctggagacgtcggagctgggtgctgtctaccaacacccaggagtctccctgacttcccaaatgtccagttcatggccccttgccccccacttcctcctggggccgctgttcttcagctttagggtctcaggaggttagccagggtgatgggagacacccctagctctcctgcgccctctctatggaggggctggagcctgtctcgccgcagggcctgggctgtgcacccttgggcctggcctgttcccaccctgcccctccgcatggtgggcatccatgcgttgcgggaacgtggccacccctgtgctgaggagcagcacggacggatctggagctttggacacccccactcccgtgcgccccatggagccagtgtccactctgttcctgcagaaagtgaaacctctgggcaggatgggcctccaggacagggccctggggcggggggaagccaatcagtgcagcaagctgcagttactaggcacctactctgtacgtggggctacggaaccaagggacgcagctggcagacgttctgggagggcccccggctgcagtgctggggatagaccacaggggggcagggccaaggccaggagccgcctgcaggctgggacgatccagggaatggggcagccccgccggtcaggtggtaccacaccgtgggattctgggcaagatttgctgatgggctggatatgagggaaggggtgggggagaccccaagttttctgccctgagattggtagaactgcagcagagcaggggtgaaaacgccgcggtcggccgtggctgtgttggagatgcccggcagccattgcatagctgagaaggagccgcatgcagggaggaggacgacgagcgagcagttcccaaagccccatgagggaggggtttccagtggtcctggggcctgaaaagtgtgaccacctggtggctcagtcctgtgtgcatcagaggaggtggtgggtggtggtcaggcttagggtggagtttgaaggtgaccttagaggaagagcaggggaggattccagaaagatgctgaggttccatttgcacccttgcaggaggctctgctgctccccaaggcaggaaaggccggcagggtctggatgtgaggtgggtaaggagttggggccacactggcaggagcggccatgtggacactcagttgctggtgtgggcaggcaggctgtggagacgacctctagggagtcctgcacatgggcacttacagtcagggctctgggggatctgcacggaggcagggagagacagcggctggagctgagcactgggcactacgacatccgagacaccaagcagagggggagatgcagaggggcagcctgggaggccaggaggcacgagaggctggctgggagaacagaaaagggactggggcttggcaacccagaggctgctgagttcccacggtttggagagggcagggcccaactgggaatggctcatgggattgctgagcatggccaagggagccctcagcatcctctccaggccttgtgtcatgaaagaccccgagcagcggtggggctcaagccatgtggggccaggggagggaccagttgtcctaactggagatccagggatcagaggagccaccccactcacccgcctgctgtgcctagtgcacgcccgcctccggcccccctgccaccctcggccagctgctatttctgtctcctttgttctgtcccccattggacctccccccagtcaccagcctaataggacctcaacttgctaaacccaaactaaacttatcttcccctgagaggggatggtgccgtgtctcagccagcaggaaatccactctcgcctttgctcaggccagagccctggaggcactctccatgcctgaggtcctgtgaatcctgcctgcaaatgtgcctggggcccctgcggggcccacctcgcacccgcggcccacgtcgcacccgcggcccacctcgcacccactgctcagatacatctcacaattgctgcctttgctgacgcccgccctgtgttctcaacaccggagccagagggagcgctttgcagccccgggcgtctctgctcagctccgaccacctctcccgctatccccctgggctccgtctctccctgcacaggccctcggcccttcctctggctgcaggctctctgccctgctggtccccagcctggaaacacccccaggcccacccaatacctggggcagatctttcccttcctgcaggcccgccttcaccttttcccgagcccgtccttgcctggacgccagccctggcccctgtgcctggctctgtgtttctgagaccacttttgatcccaagcccctgcacgcttgctggctggtttgtttactgtcgtcagcatggagggccggggtcgtgtctcgtgccggctgccatcttcctgcacctgggagggtgctaggatgtcaagcctaggaaatgggtgtgaagaggagacctgcctttgcaggagctgaccaaggccagtgcactgggcgggaccatccgtcactcctgagcccactaactggggaggggacaggcagagcggggctgggtgattcctgagcaagcatgctgctgtctctctggctctggggcctctgccctctgcctcgatggccccccacagccgtcctggaccgccttctccacctttgggctcctgctccaatgtccgcttatcaccgagggccatcggaggtggcacgccccgtgactgcctccccctccctgtaccctgcactgcacgtgtcataattcaagttctcggctcagccacccattctcggctcagccactaatgtgtgctggaaggtgtccaggaagccctgctaagcatctgtcagtgtctccagcacagcaggaggctgttacaggtggcgcctgattcacatctgcaggacaggtggatggatgggcagacagatgggcaggggcatgtgtgcaaggacacaggatgtcagggctgacacctgggttgggctctggggtgctggcagcagggttcggagaggggagagaagcgtgtgtgagctgtgccttccccctcgtcttcccgggcactcggcattctgggtgggagggcctggaccagcccgtttccaggtggttaaataaagtctgtgcatcctgttggccacctgcctctcataggcagcagcacagggcctgatggggatacagcctggataccccactggggcctcccgcagacactcagggtccaggctgcccctcgccacaacctggaagggaggggctggtgggccagccctctggaggaggcctctcaggggaggtgggctttgagcgggatccgggaggcagggggcagaagctgagggacgtggagaagggtctgggggaggaggcggcggcaccgtgagtggactccggggcggttagcaggtggaaggcagtgagggttgaggagagggtggggcgaggcccttgcaccaggccacagtgggcggctcaaatgtgggtccgtggaggcccggggggcaccaggctaccctggagtcatctgaagtcacctgggcgtgtggagggacatgcatctgcaaggcccccatgtggcgctaagcacagagtgggtgctgcagacgggctcagccgctgcgggcaggtgcaggcaggatagcagcggtggccctgggcctcgcagtcctgcagacacacgtctggggactgctcctgggggcgcgtttctccggtgtgaggtgtggaaagttccacatggccctggcacgggattgggcaaggcctcgcctcagccccgggtgagagcagagggtgctgtgggtgagagcacagggtgctgtgggtgagagcagagggtgctgtggatgagagcagagggtgctgtgtgcacattgtcgggagagggaggcttccccccagccgcatgtcgaatcttgttggcatttccattcgtttaatcacgggctccgggagatgctgtgggaagtaccggcaggacggaggtcttgccctggtgggatgggctctcttcctccgaagcccaggctgcttgtcagtcactcacccctgggtgaggttggggcccaagttcagacatgcccacgagagatcagggagtttgaggagcggcatactctcaaaaaaccacaacagtctggtctcaatattctccagggaacgaggacacggacctccttgttctacaagagctggggtcacagctcagagcccctgtccaggctggagggagaaggccaggaggccagagggaggccagctgagccctcaggagactccaggcaggccccgatgccagactccagccctcaaacatgctgccttctggaaacgtctgtcacgggcacaccatgcaccatgccatggctgccagtggtggatgaagaagagcatgtctctgccccgtctggagctcccggttcctgtcctagttgaacagaatgaatgagagtgcgggataaatgccgggcggggagcagggatgctcgggcgggggcaggagctggagaggtgacaggagcgagggaggcggaggtggagctggggaggggccagcggggcgtcaggatttcagctgacatccctactacgctttttcacgtgcctccctctctgactcggatcctaagtgattaggatcagaggaatctctgtttccaagagaagggggactgcatggccagaccgtgggctcgggccccagtctcctgatctccgccaagcccagggccccaggaagcggccccatccttgggagctgtcctggcctcagctcccaaggatggggtccctcgggaagctgttattgctgtctacggggcaggagctccgtctttcgagcctctgcacttgtggagacaaaggtttccgaatgagcatttgtgccccgccctccccaccacccctgccaggcccaatgcagggaccaggctgcatgtgccttccccgcctcacatctcctccgctggaggagtcagccaaaaccgtggcctttggagatgtggccagagtcattgtgaattttgctggcaggtttctctgttgtcatttccactaaaaaatacgttccgttctggacagtaccacatctgtcccctgtcatccgatggcacggtcgtgacctcccatgccttgctttgcattgtgtcttaaatatcctaggctctgataaaaggcactgtggataccgggaagcgagaggagtggactaggggggaacagggacacaaacttgaaaaagatttatttcccatctacttgtaaaaaaaatcactcaaatgccccacgcctgtaatcccagcactttgggaggctgaggtgggcagatcacctgaggtcaggagttcgagaccagcctggccaacatggtgaaacccccgtctctactaaaaatacaaaaattagcgtctgtaatcccagctactggggaggctgaggcaagataatcgcttgaacccaggaggtggaagttgcagtgagccgagatcccaccactgcactccagcctgggcgacacagtgagacttcgtctcaaaaaaaaaaaaagtcacttgagacggtttacacattttaaacagtcaacaggtgcaatgggaatcttttaacaaaaccacaaaatccaacttaatctgaaatagaacagaacccatgcggcgggagggtgatgatggggcccagctcccctccagctcctggccggtgaggacaaagagtctttcaaggggctgtccccgccctccacattctgaggaaggcagcctggaccctgggcactgtctgggcttggggctgtggccgacatggcgggcagtggcacaccgtggccacttcccccagttggatggcccgcgtggatttcagggtctgtttcatccaaccaagagtttctgagcgtcctgtcggtactggctatctggacacctcggggaacaggagagaccccgacccctgtgagcacctgcccccgagagcacctgctcttccccatccgtccctgtgcccagggcttagcgactgtcctctgcgtagtgaatctggattcccgtccctgttcctcggcggagcctgcccagccgtcgttcctcctggctgggtttttgtgccaaggcgtggaggtcatgcctcgtgcatgggagcttcctggacattggttccaggagggctcccgggcgagagtcacttccgatgaagtctcaggttaccatacttctggaccctcttgatccccacaaccatcctacgaagtccacgttgatttcttttttggtttttttcgagacagagtcttgctctgtcacccaggctggagtgctgtggcgtgatctcagctcactgcaacctctgcctcccgggttcaagcaattctccttgctcatcctcccaagtagctgggattacaggtgcccaccaccacgcccagctaatttttttttgtagttttagtagagacggggtttcaccatattggctaggccagtcttgaactccggacctcaggtgatccgcctgcctcgtcctcccaaattgctgggatgacaggcatgagccaccacgcctggccagtacatgttgatttcatccccactctgcagatgagaaaacgaagacctagggaggtggagcgatgggccaggttacacaggtggagctgagacttggccccaggactcctgacctcagagccctgcttggccccccaggtccctgggaggtctctcctgcccctctcctggatgggcagagaggcctggtttccaggatggtggcgtaggggcatcagtagacccagaagaacctgctgttctgggatgggcagccctggccaccacttcctgcccaccttgtgggaacccccagacctcagccatcaccgtccccagcttggccgacggtagatgctggtgcttggattggggtgtccagccagtgggatggggcttcagggctgggctgagctctggcctcccccacactgctcctctctgctctcagacaggcaggccagggggcaggcgggaccctccacagccctcctggagggggcccagctactgggtggcctctcagtctctgacccctcattttggagcaaggtcactggcctgctgccaccccaggggcatgggtggatcaaaccagtgaggtctgggaactgtgttgatacctgtgactggcccaggcgagagagcagccccatttaccactgcctgctgcccacaccccagcccccagcccccagcccccagcccagagctaatctccagcacaggtgcacccagggaggtccccaacccatccgcagggaggagagatgaggcctcctgggtgggtgcgtgggggctgcagtatttcccctggcagagcactcctgccccgcaacaaggccctggggccccagcagggcctggtgcgtccgcggcctggaggctggcgggaaggccacccgctggctctctggctcccgcgcactccttgggtcaggcccaggagccctgcacacacatgtaggcacttgtggccgccgcgggccgggcgtgtcctaattagcccactatcttgggagctcttgttgaaagcaaaacaaaccaaaaaagtcctggttgtgcccgggttcctccccgtggcttccgggggccctctggttgtgggagaccccgggctcctgtgcaggcctgtgttaggttcagggttccctgtttcagcagcttgaccccgagcaggagccaggccccagggaaagctccttgccgccaggcaggaagcgaaagggaagaccagagtcccccgagccaggtggaggggcttgtggaggatgcctggggaggcctaagggggaggtcagagacccagaaagccccctacacttcccagatgctgcgttcccagctgcattcataactgcagctgcaaagcctctgccacccactgggggtgtgacaggggcggtgaccacaggcagggccagcgtgcagggagagaggtcccctggaagcaggaggagaggacagcgtcccctgggcagaggacaggcccagtaaccctggggaggagggggcttcagaggcccccaccccgtgtcactgagcctgaggatgagaggggaccagagggagaggccgacatcggggccctgcctgaggaaggccctgctaagggagcctgcctggggccctgggccacagaggacggcaccgagagggcttcaggcctgctgtccggacacttgtccactaattaggattcccgcgtggggccgcctgccgcaagggcctggctcactcccgctgggctgtgctaggcgcagagatcctatcagctcttctcctcttgcctcaatgactaattccttggcaccttcctcagatcatacaagaatgtggacaagttaaaatatgaaacacgttgtcgtgggtctgcatcctgcttctcccaaacaagggaggcatgggctttttgccccactggctgtcctgttctcagggatggagcagggatgggagtcgggcagggggaccctggagcctgcccttgcctgtcatcctgacctgagaagcctcagctgggcagcccttgagccccgggatgttcttgcccgggggactcaaatgagtcaggaatggggaagtcgtgcatccctgaggccatccccgggcccaaaacagggaagacctttccaggaaggccaccgctggtcacctggaagagagagggcaccacggagaggggagggtgggcaggctggcacccggtacccggtgatgggaggggccggctcatgtcccacactcactcctgggcagctggactgggggagccgtcctgcattcgcttgttcgtttgttctgccagctcgcttgttcagcgagcctttcaagcagccacgctgtaataggagcacggactgagggtgtcggctccgagccgtgtgtgtaattctgctttttctagtagccgcattcaaaaaggtggaaaggagctggcggaagtcatttaattatttcctgtattcacccgtaactgtgatcgtttcagcctgtaatcagtaggaaatggtgagcgaggtgttttccgttctttccgtggtcctgagcccttggaatcggggtgcgctcacacactgggctcaggtccatccacatttcacacacccccaccctgtgtggccagtggccaccgtatccagggtcctcgtgggttcacagtcgagtaggggagacagaagccatgggggacatgcgagcctgcccttccggagaatggctagaaagatgctcaaaccgggtgacgaaagagaacacctgaggcctgggcgctgctcctgcccgtgtggccagggctgacccctcggaacagtgacctctgagcccggacagggctggtgaagggtcgtgtgcagaccacaagtgcaggcttccaggaagggcctgggcccgtggtcgtaagcaggtctcagacacctcagaggcctcttgggcctcggtgaggagtctgggagccggggactctggggcggggcctgggctgtgcgaccagagcctggcactgccccttgtcacccccaccatcacccaacctcccatgtgtgtagctgaggcaggggtccatcctctgtgccagaagcctactggcagctcgccggtgcccagggtgacacccaaccagacaccaggaggagcaggagtagcctttctacatctttctctgaggggggcagtggctgcttccccagaccccctcacaatagcccaggagccaggagaggcgagggtcacccttccctgggatgttatattttgtttcgttttttgagacaaagtcttgccctgtctcccaggctggagggcagtggcgtgatcttggctctctgccgtctcagattcctgggctcaagagatcctcccgcctctgccccccagaatgctgggattacgggcgtccccccgtgatgtttttaagctggcaccatggcttatccacgtggcagcgtgtgggagcttccttctgtcttatggccgaggaagaggccactgtacagacacactgtttctttatccatttgccattcagtgaaccctgggctcctgggaaggacctgtggtgcaggaagttagggaggttgtggggagcgcgacagaccaggaaggaggctgcagtggtgccggagaggtgggcagggcccgtgctgcagggggtccccgttccactggtgggtgggctccccaggttgacagctcacagccagcttaatggtgccagatgatggcagcttcagccgaggcctcgtgccaagacccttgcagtggagccagggcacgggtcgcccctgacggctcaggcctgctggggctgttggctgtcctgggctggagcacacagggagagggcctgcctggcctttggtggccctgggaacagtggtgatggctctggtgagcagcagtcccctgcctcctgcccctccggcatcccgggctgagctgcctccacgttggactgcactcagtggaggactcagtagaggactcagagaggacgcaaactctggacttgcctggcgtccttctccattggatgctggaggggccgggggatgcggccctcgtcagggacctcagtggatgtgtgtcctaggacctgcagagccgagggcctctgggtcactaaacccaaccacctctgatggagaaggctgaggtgcaggaaggggctgagcctgggagtcccggcgaggcccctgcaccctcctgtgcgggcagtgcacgttttgttttttggattggagggggcaggctggtgggagggaagagtgtgctcacagcacaccacagcttctctaaagagggacacagggcagaatgaccgccccccgcccccggcccgcctccgcctggctctgccccttcctgccctgcaatcccagttcacggtctgggggtctcagcctgcaccttgctgactgctggtgacctttgtgccgtctgctggggccgctagatcactggggtcaatcgtttccccagccccatagctcagtttcctcatctgtaaaatggggacaatcatggtgcccaccgcaggcctggggagaggggtaatagggacaatcacggtgcccgccgcaggcccggggaggggggtaatagggacaatcacggtgcccgccgcaggcccggggaggggggtaatagggacaatcacggtgcccgccgcaggcccggggagaggggtaatagggacaatcacggtgcccgccgcaggcccggggagaggggggtaaaggcatttgtttgcgttgagcctcgggggtcacagggaaagcgctgtttatacatgtgcagtcttcctccagcacccgcctctggatttggaaggagggtcttcctcagcagcccaccaagtgaggtctgccctgccctggatctgagacatcgaggccagaccagcaccccctccctcagctggggcctcccttaagctcctggcagaggctgatccatgctggggtcccggggcgccacagacggtggcgcaggggacacacccacaggggttcctgttccttggtgtgtggtcctggcgggggagctgcgggtaggggcctaacgagagaaccccgggccagggggcagcaggggtgaggctttgccggcccctgagcgtggagcggcctttccagtcggggtgaggccgttcaccgagagatgaggccgcccaactgggaaaattgggctcagccattgaacagcagttccaccttatcccaccacctagagggccagacctagtgagagcccggatctggtctccagcacctcaggggcacccacgcacccaagcccaggtgtgcgcaccctgcactcagggcccacttgtgcccagcccacctcccccactgcctggctccctggggctggatctccccactttgagctgtgaggtccagaccccgatgccgcccggagggtacagtgaagcccgtgtgggcatcagggcctgggagcctcccccacccgacgcctcccctccaggtgtgcagagagtctattccgcctcatcaacggctgggtggatccccagaaaccctggcaccgggaggctgatggaggggagggcgaggtgaatatgtcagtttatcccaatgcaagtagtggcctgttgggatgggggagagacccggggaaatatttgggatgactggagccgctggccctttaaggctcctgtaacaggacacctcctagacgggacaggacgactgactgtgtgtgtttccccctccctcctcccctttcccgcgccaggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacggtgagttcccctagtccctgagggctgcgggctgcgggctgcgggctggagaggaggtggctgcgttccccgcacctcaagaggtctgagctcgccccactgtctgctcggggttcccacctggcccgggccaggaggagcatcgggcaggaggcgggtctcagggccgggcagtctgggtgtgcccacccctctagacgtgagtggccagagccagtcagcctccaaagggccacagaggggacggacttggccctgctggtgagatctctgccaagactggccagcggcttccccatgctcaggtgggatctttggtttgaaatcctgtcctggacagaggcacgggctctgctgccaagagttgtctgtccgagacaggcccacagccctagggtctgcagaacctgcctcctccaggcagcgagacgcatctgcgggtgggtggatttgggctttgctggcactgtctctggagtgtcatttccaggaattggcatgcaccaaggagatggggtggaaccaccgtgccaagggctcaggtcctcactgcggtgcccctggagacagactggcccacggtggggatcttgctaattctgataacatcacctgtgcacaaggccagtctcctcgagccaggcaccatgctcagggctttgagttgagctaactcttgcacccaccaacaacgcacagggctgactccatcactgctccccttttacagccaaggaggctgaggctcggggagggaagtggttcgcccagagttctgctcatagtaagtgggggcagccacctctgcatctgtattcctaaccactgagctgccctgcccagacagcttcaggggagggggtctgtcaggaggggcaaggtgaaggctgcatgaccccagccaggagtggagggcacgcaggggctgggcgggaaaagcagccccaagagccctccgggtctcccctcctgcaccgaggagggggcaagtgagccctgcctgggcacccaggccatggctgcaggaggggctctatgggacacatgttggtccggcccactgggcagcgtcccctcccccacgaggccccgcctccccgggcacagctcagtgctggccccctgaagtccatgcagggcggccgcattcccaccccctgtcgggagtgctgagcaaggggcccctcaggtttttccgctttaagaatcgggtcccactgccctgctggccatagctgcggttttcccacgctcctggagggccgaggggcagggcggagcctaaggtagactgtcaggctctgcaggtagccggacagtcctgccgggctggtctggggtctgggttccaggccccgcccgcccccacctgcggttgtttctgattctcactccagccacgggctcccccagctgctggctccgggctaagagaaggctcagcccggactcgctgggcttgatgggagggggctctgtgggctgttgggctgaggggcagaggacctggcacctcctccggggcctcccacctccatctggcaggcaatgccgaccccagtgctaacaccccgttttctccatttggaaattactcctccacgcaccttactgcacgatggagataaggatgggaagaccgtgccagggctgtggccagcacggtgcttagctcgcagcaggaggcccatgcgttgtcttaattgtggtggtggtgtgctggcctgggcctcccaaatgagtggttccgtggcagctgcacctgcctgtggggcaagggggaccaggcctatccttccaccccacttggaggtctgaagccaggtcagaaagccccaaggcatcctcacctgcacacctccagcagcaggagcctcaccactgcttctctcccacactcaggcttgttgcctaagtccactctctcccctctaaggacactgacctcctgccctggggtttatgatgctggtggtttctggagagtgtctccctggagtcctggcaggcagcttgtgggagctctgcctcccttcctcccatggtctgaggatgctgatggggtcttcaccatgcttggaatgcactgcatgtggtctgagctgatcctcatggaaggacaggagcaaccccctctctggctggcttcccccatctagggtatctgccacccccaccccctgccaggtgtgtggcatcaggttcaagggacttcatggttttgtctcaactgccttgtcctgcaggacggggtggccttgccctgtgggatgggctggtctgctcagaccaggcatcccgggctggtcagctgcaccagcgggaggggaaagctgtgcctggtgcccagcagaggagcagtgacacctcctcgctccctccctgctgggctctgtggatgctggggcggggggagggtgggggggcgcgaactggggaggaaaatgctgtcgcctgcacccagggctcctcctccgaagccctgtggatccagggggtgggacaaacattgataatgagatttttggcacctcagctctctggggccagaaccccctccaccagggcttctttccttgcccagggaggggcaggcaagtggtcggctcacagtgcagaacggggccgccgggcagcccgcttgctcccagctctggggtcccaccatgcgggtgctgcccagccctgctgcctgtgcttgcgtccggcctctgcaccgtgactcctggggctcccggcacgccagccggctggtaactgatagataattcatatttttctcaagtacaagtccacattggctgccgccctcctttctccccgatcaggaaaaacaccctcaccagcccccaagtgaccacagatcagacctcagatctccttgggcactgagaggtctggaggctgcggttcacaggtctgtgcatatgtgtgcatacacacgcatgtgcacacacacagacacagcaccctcccacatgcatgcacacacgtggatacacaagtaccttatgcacacgcagacacatgtaaacacacaggcatgcgtgtacatgcacaggcctccccccatcactgcccagggttctagtagctcccaccccatggaaacccaggaggaggaggaggcgagtcgtgggtaaccgagcagccagaggaaggatttgtgtttagccacgagagtgtaaccagtgaccagtgacagggcaaggccggcatttggtgagagggaccctgcatggtgagaggggtggagctggcgtctgctggggtcccaatcccagagctgcccgtgagcaccttctgcttcgcccctctgccctggcatcctcacctgcaaagagaggtatggcctgccagccatggtggggacaaaggagctggctcttgggacttcttaggtcagggcagggtacctggggagcgctccacacacgtgagctctgagtgcagtgctgatggtgacaccagtgcccttctcccagttcaacaccctctgtgggacagtgtgggctcagagtgtgggcagagctctctgcagggcatgcatgacctggcctctgagccctgctggccactcctgtcctgggagccctgcaggttggcagtggtgtggacagctggttccaggaggccctcggggcagagaatgaacaggagttcctctagctgtcagaacagcccgacgcgatgggcatcggatgctgtgacaccccggctcagccgttctgcccccagctcagcctcatcagggaaggtggctgtccttggtgtttgggaagtttggggacggggctctgaggtcaggcaagaaggcagtgtggggttggaagccctggcccagcacagcatctgtgggcacctcagggcatgctgagtgacaccacccacagcccacgaggcaggctgccatggcaggatggtgaggacacacacaggtgcgatggccagctgccccagcattcctccagacagaaagatggcccggacacagccccctgagtgccctccagctgctctcagactcagcgtgtgtgtgtgcgcgagcgtgtgtatgtgtgtgtgtgtgtgtgtgtgcgcgagcatgtgcacacatgtttgtcttaggggagagctggctccacgggtaggaaagccccccgtccaggagggacatatggaaggacggccagggaagcacaaaggctctgcacgggattcctggggagaatgaggctgagtcaacactaatgggtctggagcaaccttcccagcgcctcggaggcttgcaagcaggagaataatagcggaggtgtcccaacacgatcatggtatcaattgcattatcctaaaagtttatggaatgcatgagtggaattaataccttttactggcaccagaagcaattatatgtgcgtaaagctgagggaagagttctaacaatgtttattgtggagatgaaacgtggattattaggggaaacaagagtacttagggcgaaattgcagcaattgctgatatcatgtggcgcagggatctgcagcagggacggagcttccagcaggcctgctctggctgtggtcagcgcctcggggctcgtggcccgagccggggttggctcttctctcttcactttctggagcagccagaggaactcactcttgggccctggaggtcacagaacttagccttggaggccccaagtgaggctggggaggccccagctctgagaccctgggtcctgctgccccaccccacactgcctggttcttggaggagacaggagggagaaccccttgggggacaggattcccttccataggcatgagactgttgggggagaggcatgatccaatttacgttttaggaagaatcatctattttctaggacttctttccagtttggggacagccctgtggacccagcatgtctgattagtagcgttggcagcagcattgcccctatgtgcagggcctcccacactccccattttacagatgaggaaactgaggctcccagagggcacaccagggtcacctgtcagcagagggcagagccggacctggccccagcagccagacccctaaccttgcccttgcagcccgtgtggtgccccaccccggcccctacaggtccctggacaggtccccacgagcagcccctgccccctgccccaccctctgctcccagctctgtggggcaggtccctgtgaccctcagggcccccaggggaaccagtgataaggaggtgctgacacctcagagggacctgcctgtccctaggggagaaagccttggaccgaatggggtgtggggggagcccaggctgtaccttggcccccatgagccttccactgctgtctgccagtgaatcaaactgggactgggggtggagagctgtccctgtctgctttcactgcttggttttgttgacaaaggaaaatccctcaagaacgctttatcactggagtgctccgaggctggcgagcctcatgggcgagaagccaggcagctgggcttggggaccggcctctcctggtgcctccctgccccctctgccttcacccctcccaggcctggcctcactgccactaactcccgttgacagggggaaagagaggcccacaggggagggccgtcccaggcttctcctggacccagtgctgacgccaagatgcggtcgtaggtgacctggaccttgggccgtgtgggactcggggcaaggtggggggctcagctgggcagtgagttagttttgcttcccggtctggtgggtttctgccaccccaggccagtggtcacttctgggattttctgagattccaaaagttgaagccacggaccctggagacccggaccctggaggcccagcccctgcctctgggtagagaaggccctgagcgacctccagaccttctgtcccttttccgaggagcctcaggaagagggggacagacaattccagggtgtcccggctggaaagaaaagcatcttctctgcactccaggcggacagcgtgaggctcagagattacgtggcggccgaggctggtgtccacagccaggggttacgatggggctgcagaggccgtgagcggaacagggcattttagggcagaaagacccttttggagaaggtaacagcactccaggcttcagtgaggcagaagtcagagcccatggggaaaccgcacagggggattacctaaagcccagagccaccccaagggttgcaaacccacccctcccccagccatgccactggagcgaggcacccagctccttgcacctggcgttggggagacaccactctctgcaggggtcagagattcggaggccaaaattctccttcccccaggcatttcaatgaagatttacaaagtttagcaaaaacctagattctagccaactattaccttaaaagctgaagagggaccaccccaccatgtccacagcttactcccctccctccgctgtctccggccacctccagctgctgccaattccagcccccaaggctgtcccaggaagctgtggccagagactccgggactgtcctgtgagcagagggcacccactgaccctggggcacccttccaatccccacagctgacaaagccgggcctcaaaaggctgggttaatcctggcttctcctcaaagccaccagtcagggtgggggtgaggatggtgggggcaaggatggtgggggcttcctccccaggagttaaggggccctctctgcagtgagcagagcaggcctgttgccagcctgctgggcccctcgtgggacagctccagggcctggcccacagtcccgctagctaggtccttgccagaggccggaggagaggccaggctactggcaacgggccctccagctggcgctgtcaaaaagcaagttgcgggcagaggaccctgcgcttggtcccggcccagggcagaggctgagtgtggtgctttgaacactctgtgtcttcagagcggaggggcagctgctggtgggcattccggggccctctgcaagccccagcttttgtctctgcggacccagggcactgccctgccaccccctctgtccccaaggccccagatggggtacctgggtcctggaataagagcagatggagttcctcgccctgcctgggcagctcattccttcccgggcttgggcagagtgacagtgatagtagcagccacagggcacccgcacgcggtctcagtgaatcaggacagcggcgaccgggtggggactgggccctgagctcctcacacagcatctcggcagcaaagtggaggctggagctgtccaggctgggccacccaatcccagccagacacaaggcagtctgtgtgagtctcagtctctattgtccatggagacccatccccagcaggaccagggcaggtgaggcccctggctgttgttccccttacccctaaggggcttaagtccagccacggggtaagaagcccatgtcccacctgacacctctgtagtaccgtctttctggaacccggggtgacgcctctgcagtgcccagtcttcctggaacccaggggtgacgcctctgcagtgccgtcttcctggaacccaggggtgcttaaggcgggtctctgcctagaccccgaccccaggccccaggacccaagtcaagcccagcagtgacaaagggctgggagatggagcttgggggtcagacagctatggtctgggtgctggtccaccccagcttagcaggcaggtttgggtcactaaacggagtgacagtgcctgacctcccagggccaaggtcaggtgagggccccgcgcagggcaggcaccagtgggcagtggatgtggccatgagggtggacccaggtgccccattccctggcaggtggacagcactcactgtctccccaggtctccacaccaacagaggcagacaccttgggcaaacgctgcctcgcagcctcccccaacactaggcccctcttatctcctctgcctgtggccctcgtctcctactggacccctgggccttcactatgcactggagacaaagccaccaagtctatcctgggctcagcacatacctgcttccctcccctaccccgatcatagcccaggatggagatccctagaggcagccgtgcatgggacgaggatcgagcaggctccagctcctgtggtctgggtgcactcagtgtctcccagggagccgcgcttccaggccgttgagagtcccccgtgtggctcctgctcacctgtttaggacatggctcaaggtcgtggtggggcagactgcccagctcctcagggttcccacttgcccctggcctgccctccccagtgagcagtttcttgtccacagcctctggggctctagcaggcctccgtcagggctgaggatcgcttggcatctgcagaggatgtttctgcctctggttcatcctccatagagctcctggcctgggagccccggctggccagcatgggggtgccagcagacacatctgtctcctgcagcccccccagccaggagctctttcacagcagcctcttttcttgggcagcgctgggcctggcactggctgtggcctcacaggcattctgaagctcgcttgggcctctcatctgcctggcccatgggctgtggatgtcctggtgagtgagccgtcactgcctcgaccatgggagccccagcttaacaccaaggtgttctgaaacaggggcgattgccacatgtgtcctttccccctccccaggctagtggcttccctggggcagggagggaccagccctgtgacatcctgccaggcctccctgacatctgtcagagcccagcctgtgctcccagcagctctctgagggcgacagtgactgtgcaccagtgaaggccacagcctcccacgaagggggctgtcaccaagggggccctgtggctgccacctgaggatacccttcctctctcagaaggagaaagggacccaggaggaccctaatccacaggctgttgaccctggctcaggcatgtgttttagggggtccatctgtgaacccacgaatttaatggaaagggttctgtggctcagccccaggagcttttctagggagaggaagggtccagggccttggcagagggtgggctcaaagaggcccgtaaccccagagaggagagagatgcacccctaaacacacagacgcacacacaagcaagggaactggataaaagtgagcaataaaaaaaatcgtttaaaaaataaaagcccccactgcaggccccatcttccagaatctgttgcaacagattcacccacgctggttaacggtatttgcggtttgcaagatgctacacgtcccaggaaaatgacagacaagttattatcacctctccgctgtcctcctgcccaaacctgcccgtgccgggcacccagctgccggggagcgaggagcgggcacaaggaaattagcagccccccgctgcaccctcccctcacccacccccgcaccagccctgccaggcccagggctcccagccaggccgggcccatgttgtactggggcgggggaggaggggaaggagaggagggtcggagaggagccggcagcgtggggagggatgggcacagtggcgtttgggcaaaccctttcctgcaagcaggacggtgcacgcaccctgggcaggcaagtccaggcggctccgtgtcaacagccgaagataaatacgattttatcagctcggaatctgttgaaacacatccatctagcggttctagggaaggagaaggcaggaggggggcggcggaggggaagtgtctccacgtgacctttcctatagaataggctccaccggagtcctcctcctcctgcccgttttccacagggccaagcccaggcctgaagcctagaggcctgctggggagacaggaggaaggagctgggggagcgctggagccgtcctgggctcagccaccctctagaaggacctggatctctcagggctcccttccctcctgtggccacctgtgtcacccacccccagatgctgccagggcaggggacatcacagacatcctccccgaggccacccagctccggcccggctgggcacctggggtccagttagtgccagggtgaggtctgccaggcatgtatgccccaaaggccatgtgagcactgcactggggacacctgtggggaggagagccaggcccaggaccttggtggccttactggccagaggggaggagaagtgctcacatcgcctgaggacaggggcctccttgctctccaccctgaggcctgggcctccctccgccactggcccaggtcgaagacctgtccgttctaggccgctccacactccagtccgagcccccacttcccggggtgggtggtccggccgccgcctgcaccgagtaccagggacagctcccggcgcgcccaagctcctccccggggcggggcggggcggggcatccacagtgctccccgcgcctgggcccccaggacctcttgcagacgggagtccctcagacagtgcagagacgggagcacgcactgggccctgcacccacttcgtagcgccctggcctgggacgccccaccacgcagcttccagagcaaggatcgccacttcaccctgcccggagacccagagggagtggggcgggctcagcagggcgctgctgagaggccgctgcctaggtctgcgaaatgggagcactgctgaccctgaggcccaggcgggcgggagctcaggctccgcagaggactatggccgggggtgctggggcaggggcctaggggaggggctgcaggggccaggcaggagctgtgaaacccctcacgctgttgagactccatggggctgtcagggagcgacggctgccggggcctctgcccgcaggcttggttgcacccagagccttactccatctgtgtccaactggctgaggagcccaggcggcctcccctccccctgagtgtctggggctccttggtggatctaatgacccccatctcaggccatgggctgtggcactagggtggaagaagcctcgggggactcagccccggaaagggaactgtagggaagcggggcctgtgtggctccagccccccgcaaccaacacctcctcacctggtgctgagaataacgagggcgcagtagccactaacacctgcaggccactgtgttcccaggggacacgcagtgagtcagagatgcaggtggagaggcttgtgcagtggctagaggcatcccagctgacgagcacaaagccaaaactgccacccacagggccggacctcagaggcccttctccttttgccgcccctgagactctgacctgagccaccccggccggggtctgtttcaaggggggtctgccgcgccctccctgctctgtggtttccctagggagcggctaggatggatggcatttgttgagtaccacctgtgtacctccatctgctacacgttactgaggagagacgagggggacagagccaggtgcctgaattccagggggcctgtgtgctctgcacacaagaggtgctccataaatgctcagcaatgggcagctcgccctgcaggctgccctggcctcggagaagcctggcgacacggctgccggccctgtgttcctctcccctgctcggggcactggcagacaagagcctgccaccacctggcccctcctccttctgtccccaaccagcacagatggagaccaggcgtggtgtgtagcttcaggcagggcctttgtccaagagaccagtgcctggacacaggccactgcaagtttgggccaagagccctccctgtctgagtctcctgagggtccgagtcccagagggtctgtgctgcgagctgttcccatgtgccctgggggcagggctacctgcttatccttccaagtgatgctgtggggagcaaagggggcatttgtaatggtggggacactgtacatcagtggtcacctccagggaagccagactgaccccacaacaaggagactgctgtacttcccgctgtgcccaagcctgcagctccgacagtccagggcaggcgcccgcacaggggtgggctgctagctctgcaaggctgtttctgcttttctttttttctctttgtgtgtgtgtgtgtgtgtgtgtgtgtgtgtgtgtgtgtgtgtgtgacggattctcactttgtcacccaggctggagtgcaatggtgcgatctcggctcactgcaacctccacctcccgagttcaagcgattctcctgcctcctgcctcagcttcctgagtagctgggactacaggcgcccgccaccttgcctggctaatatttgtatttttggtagagacagggtttcaccatattggccaggctggtcgaactcctgacctcagctgcctgccttggcctcccaaagtgctgggattacaggcgtgagccaccgccctcagcccgtttcctgcttttctaaacagcgcccagcctcccctgcagggctgtgcatgatggttccttcctgtgttttaaacaggactggggatgggcggcttcctgcctaaggccctgtgcccaaggtgggggtcgcaggcaggggcagtggagccactctggctccaggggctccaggtggacggaggacctaggaggggccagctctttggtatccaattcccatcctgaggaggccactgaaggacccccttccacttgtccctccagccccctcacacccatggcagggacagaccagcgttcctggctgggtctcattcggggagcccaagtagctcaccagagaggggaccgctcccactgcacaggaacaagggcactcagggtgccggggacccaggccccacccaccatggctcgcagcctccgtcagctccatctcccctgtctctttcctttttccttcctggcttttcgtgtgcctgcacctgccaaggacctatgtggctcctgagagcccctcatgtcccttgatggccagagaggcagtactggtggccagtgggggtcagggggtcagggccccctaacttccttggcaaagggaagactccacctgcagcttccctggttctgccagtagctccctgtctctgacctcagtttccccaactgttccacggtggagtgcgatgggacattctccagggcacttgcggctgcagtgacttgtgattctgagtcatcgggggctggtgaggggcacagagggcatggggtggcagcagaagtcattctctgagcctgagactggggatcattcctgatggccctttggggagagagcatgaggactcccagcaggtgaccaggagccagacgcttgggaaatcagccagcttggaagtgagtggacgcccctgcagcggcctcagcggggtcacttttagaactcatgagagccggcctgggtcctcagatgggcagccgggccctgtgaggcaaagaagctggaggcctctgcaggggctggctcaggaagggtgtcatccagtcctcctgcagcagggcccacgccagctccagacagacctattagctcctcgagtcccaagctggggatactggggctgtgagcccagaggggcccccagagtggccaagaccaagccacacagctcggctgctcagacttggtggccccagcaggagagggtgtcagagtcaccagggctgctgaggccatgagaggccttcacaccaacccagagagctctctatggaagcttgaatgcatagtgggcaaccagcccatcacacattaaccacttgctctgtgcaaatgccagagaagcctagctctggtcttaaaaacagattcaatgctgcaaacccacctcttcaaaatgccgcagtcagggacatggcttccacaggcctggctcccagcccccgttcccgccctcactctccagcagccccttcttgctctcctggcctttcttgtccccatccataaacctaaagcctctctgcctgactgccaccggcactcacacccctgctgtcatggagcccaaatgacccgatggctgtggagtgggtgccagggcagctgtgcctggattcacgcctcaaaggacagacacctggagggattcagcagaggggctgcttggggcagtcttcatctgggggttgtggaaggggcacccatggggaggacgtggctcccaatggggggtggcctggacaggggtgcagttgggaccactggtctcacccgctccctctcccccactccagtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggtgagggcccccagctcctctgcccacggtggcactttgcccagcatcccggacagcacagccgggggctgcctaactgggagagagtggggctgacagcatgggcttagccattcccctgcggagggctttcagtgcctccaccagcccccattttcccagttctgagtgggacctgggggggcccatgctcctgggcaggggcaagtggtctgggcagagtctgaggggcagcggccttctggggccccagagatcctatgagtcatagcccctctctccagtgtgcctggcagggcctacgggctaccccaaggattagcaggagaatcagggggcagagccactgggcaggcacccccagagcacaagggctgccagctggcctgagcctcacctggaagcccacaggactgggcctggtggtctcagttctgctgcgatgcacctggcacagctgggcgcctctctgcacctggcacaggggtgggcacctctctgcacctggcacagggctgggcacctctcttcacctggcatggggctgggcacctttcttcacctggcatgggactgggcacctctctgcatgtgacacagaggtgggcacctggcatggggccgggcacctctctgcacctggcatggggctgggcacctctttgcacctggcacagggtgggcacctctgcacctagcacaggagtgggcacctctctgcacctggcatggggctggacacctctctgtgcctggcacagggctgggcacctctgcatctggcatggggctgggcatctctgcacctgacaccggggtgggcacctctctgcacctggcatgcagctgggcacctctctgcacctggcactgggctgggcacctctgcacctaacaggggtgggcacctttgcaggtggcacagagctgggcacctctctgtgcctggcacggggccagcacctctctgcacctgacatggggctgggcacttctttgaacctggcacggggctgggtacctctctgcacctgacatggggctgggcaccctttgaacccggcacagggctgggcacctctctgcacctagcacaggggtgggcacctctatgcacctctctgaagtgtcgacccctcccggcaggacagtctgctccagccagccacctcatccgcgtggaaggcaataatctctcgcagtatgtggatgaccctgtcaccggcaggcagagcgtcgtggtgccctatgagccaccacaggtaggccaggagccaggctgtgcccagggccctgcagtcagctgtacgggtcgggggaggggtcccctgaggcagcccctgtccctcctcagttggctgatctgcctgcctgtcctgtcggcatctgtccagggctccctgctctgtgataagtctgtgtcggcggctccttcctcacccacacccgccccactgtgcacactgctgctctgtccccacatccgcctcgggcactctcggggcctcagtgtgcccagctccatagtggggagtgggtcttcagccttgccctctgttggtgcccaacactggttccggcctggggctcccagacacagggatttgggagatggggaggtccccgcccatttagaccctggattggctggggcagaaccaaaccagcaacagcgcctgaaggggtggcaaattctacaaagggggttgagggatggtggaaagactcctaggccaggccaggggcccaggagaggtggcctgcaggaggctgaggctggtcagcagggtggagagccgggaggccccgctgggcaccacgtgggtggggggtgcaggggactggggggcatataggctggaggggaggggacacggagaggctgggggctttgacttttggcccaaaggcagcataagtttctgggacacaattctggagctgatgtggggcccaactggtgtgaaaggctggggtagggggaaacagagggtttgaagttactgcgggatggtggggcaggggcagaacaggaggtgaggagtgggtaccaggcccccaggggaaggcaggcaatggcaggcctctgccttccctgtacctggttctgagaccaggctccatgctgtacccagccccagcctcccccaccaggtccccatccctgtaccagacccccaggacaccccagactcctgtacccagtctccaggtcctccacaagcctctaccctgtacccaggcccccttcgacgtccccatcccaccatcctctaagagcagccccttatgtcagcagaaccagggcccgggagggctccctgaaacccatgtcccaccctcacctgcctaggcctgccaggaaggcagagctctatcgccccctggtggctgccgtgtgacagcagttctgagaaaggccaagattttcccaaacccctaatagcttttgtatttgtccccagggtgacatgaaaactgcccacattgtggtctggggacactcattgatcaacggttttggttcatggctgggcgcagtggctcacgcctgtaatccaagcactttgggaggccaaggcgggtggatcacttgaggttaggagttcaagaccagcctggcccacagggcgaaaccctgtctgtactaaaaacacaaaagttagccgagcctcgtggcgcatgcctgtaattccagctacttgggaggctgaggcaagagaatcgcttgaacccgggaggcagaagttgcagtgagccaagatcgcgccattgcactccagcctgggggacagagagagactccgtctcaaaaaaaaaaaaaagagttttggttcatgtctcagctgtactgcaaaatccctgggaaacaggagtgtgctgggggtgggttcgctggggacagctctggttcctctttctgcccaggtgagcccgcagcatgcaacacacacgtagggccacaaaatctgtgcaggcacactcacacccagcatctgggcttgacctccagcctgtgtcaggggagaaggttggggcaaacagaccacaggactctgtgcttctctgagagcagagaccaggtctgagccctcccagaacccagaaccagcccagtgcttggggttcagtgatcttcatgaatgggtggctggatggggtgagtgggtggatgggtggatggatgggggtgggtggggtggatgaatggatggatgggtaggtaggtgggtggatggatggatggataaatggggtgggtgggtgagtggatgaatggatggagtggtgaatgggtgaatggatgggtgggtggacggatggatgaatagggtgggcggatggatggggtgggtgggtgaatggatggatgggtgggtgggtgaatggatggttgggtagagggatgttgaatggatgggtgggtagagggatgggtagatggggtgggtggatggatggatggatagactgatattgttgaatggatgagtgggtggatggatgtttagatggatggatagataataaatgggggagtggatggatggatggggtgggggggtggatggatggatggataggatgatggatggatggatggggtgggtgtggggggtggatatgtgggtgggtgagtggatggatggagtgggtgggtgggtggatggatggatggattgactgatattgaatggatgggtgggtgaatggatggttggatggatggacagataatggggggagtggatggatggatggggtggatgggtggatggatggatgggatgggtggatggatggggtgggtgtgggggtggatgtgtgggtggatggatggagtgggtgggtgggtgggtggatggatggatttattgatattgaatgggtgggtgggtggatggatggatggatttattgatattgaatggatgggtgggtggatggatggttggatggatggatagataataaatggggggagtggatggatggatgaatggggtgggtgggtggatggatggatggataggatggatggatgaggtgggtgtggggggtggatgtgtgggtgggtgggtggatggatggatggatggagtgggtggatgggtggatggatgaatggatgggttgatattgaatggatgggtgggtggatagatgggtagataataaatgggggagtggatggatggatggatggatggggtgggtgttgggggtggacgtgtgggtgggtggatgggtggatggatggattgatattgaatggatgggtgggtggatggatggggttggtggatgaatggatggatggatattgaatggatgggtaggtggatggatgggtagataataagtgggggagtggatggatggatggatggggtggatggatgcatggatagacgggtgggtggatggatggggtggatggatggatggattgattgatattgaatggatgggtgggtggatggatggttggatggggtgggtggatggatggggttcgtggatggatggggttggtggatggatgcatggatggatattgaatggatgggtaggtggatggatgggtagataataaatgggggagtggatggatggatggatagatgggtgggtggatggatggggttggtggatggatggatggatggatggatgaatagataaatgggttcgatggatggatggatggacggatggatggatggatggggtgggttggtggatggatgaatgagtggacagatatacaaatggcaacaactatagagcagggcatccccctgcctacgtggagccaggaccagacatggagctgggggctgccaccttagtggattggggctgcgtgctgatgctagcccctctccctgctcccccatgtgcaggtggggacggaattcaccaccatcctgtacaacttcatgtgtaacagcagctgtgtagggggcatgaaccggcggcccatcctcatcatcatcaccctggagatgcgggagtgagtcccgggcacacggggtggaggtgggacagggctgggcaggcacggccgggggagaaggggagctgtcatggagacctgcaggccaaggctagcttggggaagagactttggggtgtgctgctggaggaaggaaccgccccctggcctgcagggcctgcctgggcacaagctgggcctccggagggaggtgggagtccccggcgaggtctcagggcagcctcacagctttgagcctctgactccctctagcgggaacactcgctgccggcactgggtgctctgtggtgaccgagggctctcaaggccggtcctgcagggtccgaggtgggtggggaaggtgggcaggttgagggtgggcagggttgagctcacaattctggctgtgcccacccgacagtgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtggtgagcggccggccaggggaactggacgcgtgtgggaggagaaggggacacattggcaggacacaatgtgagcccgcgtcccagggacagggccagtccctgaacggccccccacgcccagactcctccctgacggagcctgagagcagcccccatataagtcgcttgtcctgggccaagggcacctcagaggcctgggtggcaccgcaggtttgcccgtccctgtgggttgctcaccaccggacccacctggagaatcgattggccccaagggtggggcaggtctccctcctcccggaaggaggcctcaccctctggtcctgcctgctcaccccgcctgccctgcctggccttccagccttcaagcagagcccccctgccgtccccgcccttggtgccggtgtgaagaagcggcggcatggagacgaggacacgtactaccttcaggtgagtgtgtgctcctgcacggcagccgggagacctgcctcacctctgtcgtctgctgagcccaggctgggccatggggagggactctggagaccatggtggagggggcgggaggagcccagccctgtgtgagagggtccagagggcagaacctgcttgcaagagccagaccagcaggacccaactgcagggcattcctgagagtcccctcagtcccaaaaacccagcgtcatgccatttacaatgaagccatgtgtacatagcacaggtagggtggtgcggagtgccaccagggtagaagttcagcaagaatccaggaccctaacgttggccaggacccgtggccacggccagcccccatgagtgtgcctctcacatgtggcctccaacaggtgaattaaatcggcacaggcttggctgggagtcatcttccatgatgtgaactttctgttttttgagctccagaatgagccccagttggggtcagtggctcatgcctgtaatcccggcattttgggaggctgaggcgggtggatcacttgagcccaggagtttgagaccaaagtgggcaacatggtgagaacccatctctacaaaaattagctgggcgtggtggtggcgtgcagctgcagtcccagctactcagaagactgaggcaggaggatcacctgagggcaggaggatcgcctgagcccaggagtccaaggctgcagcgagctatgatgatgccactgcactctagcctaggcgacagagcaagacgctgtcgaaagaaagagagagagagagacagagagacagagagagacagacttggtttctaaaaacccagtatctgttggtaggggaggaagagggaggcttgggggccacaaggagcaggcatggttcttggggacaggatacctgcccactgagtcaggggctctggttagacctgcttcttgggaagaggaaagaagatcaggggatcctgagcctctggggtgctggggaacccccagaaaggacagatgctttgccaagcccaggtcctcctgaggctgcggccacccccctcccgtgggggtctggggcacgtgggcagagatctgctcctctgtgctcaggtgcgaggccgggagaactttgagatcctgatgaagctgaaagagagcctggagctgatggagttggtgccgcagccactggtggactcctatcggcagcagcagcagctcctacagaggccgtgagtcagccctagcccaccatcagtgtggggaaggaggacatggcttaaccccccaggagaaggccaggaggaccagaaacccctccagaaggcatcatctgccagggacaggcagcagggtccagagcagagcccaccccacatctcctcctccaggaagccttctagcacttggggctgccctgggaccctgggtcatggcccttgctatgcctctgccactgaggggccttgtaaatgtctgctgagtggaaaggccaggaggggtggccagagtgaccatgacccaccaagaccagagtccgattccagtggcacaggtcatccccctgcctcccggccccgccatggccagtgtccttctcaggcgcaggcccagtggccgtgcatggccatggttggggacagggaggctgggggaggatgaagccactctctgacatcagaggctccacccattcgcagcatgggggcatcacgggcatgggtggtcggtgggcacgaggctgccttgcttcccacccatgcgagccgttgcttctgagcaggagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggtgagtcccttgggcagtgcgggcccacgggcagggcggggaggcccactgggggcgcctagctcaggacacaccacccagctcgggacccagggcaggtgtctctgtggctggctccttccagcggttccaccctctgggcaggaggcgcagccacggatagccctctctgcccactcctggctgtgggaggtggaggggggcgtggttaagagcgtggaacccacatgcatgcactgcctcttggcaggcgagggagcttggggaaggctcttaacattacacagcctgtttccccatcagcaaatggccacagaagtaccaggctcactccttgtgaggaataaatggtgcaagacctcatcaggggccccagcacaagccgggggctccattggatagagtttgggcccccttcccctggaaggtcctcatgtgggcaggaccaagcatgttcccagtgccgtgagcaagcacccccaggtgtttcctgaggccctgggatgtggccagcactccagtgccagctgcgattgcccttacaacccagtgccccgtacgcacggtcacccccgtccctactaggcggggcgaggagacagggccccaggtgttcagcccttgctcaagcctctagctggcaggggtgatgcccagcgtcacatcgccaggccttgggatggctccctggtgtccagaggtgtctggagcctgggtggaggctgcacctggatgcccagcctggctgccctgatggccccacctgcctctcacccaggccccgggatgctcaacaaccatggccacgcagtgccagccaacggcgagatgagcagcagccacagcgcccagtccatggtctcggggtcccactgcactccgccacccccctaccacgccgaccccagcctcgtcaggtgcgtgggctgccgagggcctgagcatgtgctgtcaccctgtctgttcacctctgtccttctggccatgtcagctgccctgccccaccctgtgtgctcaccactcgcaaccctggatcagacaggcgggcgggggcagtcaggccaggagcatctgcagatgctggggaaatggtccacttagaggaaaagcacaaaaagccggggtcctccactgacctgtccccagctgagcacgtcccctccctgagggatgccgtggccacctgtgggctggagccacccttcggagacagcggcagtctccgccccagccaggccactctcagagatgggggctcgcgcagccctgtgctcggaagctaatgctgcttcctttctcaaattctctctgcagttttttaacaggattggggtgtccaaactgcatcgagtatttcacctcccaagggttacagagcatttaccacctgcagaacctgaccattgaggtaacgcccgggtggaccccgctctgcagaggcagtagctggaggggcccctgtccggagggcaaagagccttctcttccttgctctcgtggctgggaaacttggaaaccctttcccacgggcaagcagatgcgatgatttgactcttgagagcttaggcagatgcagccaggcacgtggctggtggcgcgggacacaggcccaggcctccggatgctgaactggtcatttgagcctttttggactcccagcagccagtgtgcctttgattttaggggatgggctgtttccaaggcacaaagaacagaagaatgtaaggccccgagggagtcagtccagttcagtgccatttacagagaggtcagcgccatttacacagacaggaaaggggacctagggaaggcaagcacctggcccgaggccacacagctcttggcacccatggcagctgactgcaggcaccatgattaaacagccacggcttgtctttgggttagagactagtggagtacaaagcctgctggtagcctaggacggtgtgaaccacagggcaccgtcagtcaaggaagagcaagccctctggtgggaacctgccccccagccagtgccgcggcccaggtccaaggcccgtcccagaccatccccagcctggggctgcagacagagatgagggtcagtgcgagctagggccagctgctcagcctaactgtccctcgtgcagagagtggccgcgtctgtgtccactaaccgccctccccgcaacctgtccccagtgacccacgctgagccagctccaggtcacgttaacccttgcctcccctgagtgatgtgtgtgcttggtgtggtgcccagagggtgttgggagctcagggatgagctgggggtccactccagggggcagggacatggagaccaaggagggccctgccctgaggctgggaggcagttcctcccccagggccaggtagatgctcagggggctccatgtctaacactcccaggtcagggcccaggccccgcacaggccaggagtgactctggtgggctctccccctcccccgtctcctgcctactctggttgggggtgtaggggccagggtgtggtgtggccagacctccaggcccagggcgaccccccctgctctccctgctccactgccccctgcccctaatgcgccggcctctcgcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttc

SEQ ID NO: 193382 - DNA, 2586 bp, homo sapiens
gattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 193383 - DNA, 19144 bp, homo sapiens
gattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattgggtaagctcctgactgaacttgatgagtcctctctgagtcacgggctctcggctccgtgtattttcagctcgggaaaatcgctggggctgggggtggggcagtggggacttagcgagtttgggggtgagtgggatggaagcttggctagagggatcatcataggagttgcattgttgggagacctgggtgtagatgatggggatgttaggaccatccgaactcaaagttgaacgcctaggcagaggagtggagctttggggaaccttgagccggcctaaagcgtacttctttgcacatccacccggtgctgggcgtagggaatccctgaaataaaagatgcacaaagcattgaggtctgagacttttggatctcgaaacattgagaactcatagctgtatattttagagcccatggcatcctagtgaaaactggggctccattccgaaatgatcatttgggggtgatccggggagcccaagctgctaaggtcccacaacttccggacctttgtccttcctggagcgatctttccaggcagcccccggctccgctagatggagaaaatccaattgaaggctgtcagtcgtggaagtgagaagtgctaaaccaggggtttgcccgccaggccgaggaggaccgtcgcaatctgagaggcccggcagccctgttattgtttggctccacatttacatttctgcctcttgcagcagcatttccggtttctttttgccggagcagctcactattcacccgatgagaggggaggagagagagagaaaatgtcctttaggccggttcctcttacttggcagagggaggctgctattctccgcctgcatttctttttctggattacttagttatggcctttgcaaaggcaggggtatttgttttgatgcaaacctcaatccctccccttctttgaatggtgtgccccaccccgcgggtcgcctgcaacctaggcggacgctaccatggcgtgagacagggagggaaagaagtgtgcagaaggcaagcccggaggtattttcaagaatgagtatatctcatcttcccggaggaaaaaaaaaaagaatgggtacgtctgagaatcaaattttgaaagagtgcaatgatgggtcgtttgataatttgtcggaaaaacaatctacctgttatctagctttgggctaggccattccagttccagacgcaggctgaacgtcgtgaagcggaaggggcgggcccgcaggcgtccgtgtggtcctccgtgcagccctccggcccgagccggttcttcctggtaggaggcggaactcgaattcatttctcccgctgccccatctcttagctcgcggttgtttcattccgcagtttcttcccatgcacctgccgcgtaccggccactttgtgccgtacttacgtcatctttttcctaaatcgaggtggcatttacacacagcgccagtgcacacagcaagtgcacaggaagatgagttttggcccctaaccgctccgtgatgcctaccaagtcacagacccttttcatcgtcccagaaacgtttcatcacgtctcttcccagtcgattcccgaccccacctttattttgatctccataaccattttgcctgttggagaacttcatatagaatggaatcaggctgggcgctgtggctcacgcctgcactttgggaggccgaggcgggcggattacttgaggataggagttccagaccagcgtggccaacgtggtgaatccccgtctctactaaaaaatacaaaaattagctgggcgtggtgggtgcctgtaatcccagctattcgggagggtgaggcaggagaatcgcttgaacccgggaggcagaggttgcagtgagccaagatcgtgccactacactccagcctgggcgacaagaacgaaactccgtctcaaaaaaaaggggggaatcatacattatgtgctcatttttgtcgggcttctgtccttcaatgtactgtctgacattcgttcatgttgtatatatcagtattttgctccttttcatttagtatagtccatcgattgtatatccgtccttttgatggccttttgagttgtttcccatttgcggttatgaaataaagctgctataaacattcttgtacaattctttttgtgatcatatgttttcgtgtttcttggagaaatacttaggaggggaattgcgagtttggaagtaaaaagtagctgtattttgaactttttcagaagctctgagttttccagagcggttgtaccattttacactccaactagcaaggtatgggagttattatggttgtgccacagccttccggacattaggtattgtcagtctttctaatgtggtatatccttgtggttgtaatttacagttctctattgactaaggatgttcagcattttttcatgtgcctattggccattcgtattttgtttgtaaagtagctcttcgagtcttttacctgttattttggttttttgtttgtttttattgttcagttgtgggactgctttatacattctggatacaagtcctttatcagatccatgtgtcgtgaatgttttcttctgatctgttgcttgcctatttgtttgctttacagagtttacagtatcttaagaggagtggatttatcttttttatgttcagtatttgccttgtcctgtttaggacatctttttttttttttttaaccccagggtcatgaagatattatcttacattttcttttaggacctttatggttgtaagttttacagtaaggtccttgagccattaattaattcttaaaattaattgtttatggtgtgaggtgtaggagtcagtctctggtatctttcctgtatggaaatccagttattctgtctccacttgttgaaataggcttcctttctctactgaatgcttttaattttaattattttacagttggagtatagggctaccattttagtgctattttctttttttctttgttaatttttgagacagggactcacactgttgcccaggctagagtacaatggcacaatcaaggcttactgcagcctcgaacccctgggctcaagcagtcctctagcagcctcacgagtagctgggattactccaccacacccagctaactattttatttttttgtattgacaggatctcactatgttgcccaggctggtctcaaactgctggcctcaagctttcatcccatctcggcctcccaaagtgctgggattacaggtgtgagccaccatgcctgacctcttagtgctattttctatttatctcctctgttctctgctctctttaaacgttggaggaagaaacagtacccatcttacacaaactcttcagaaaacagaggaacagactgggcgcggtggctcatacctgtaatctcagcactttggtacgctgaggcaggggatcatttgaggtcgggagttcgagaccagcctggccaacacggcgaaaccccatctctactaaaaatacaaaaagtagctaggcgtggtgacacatacctgtaatgccagttactcaggaggctgaggcacaagaatcccttgaacctgggaagcggaggttgcagtgagccgagattgcgccactgcactccagcctgggcaacagagtgagaccctgtctcagaaaaaaaaagaaagaaagaaaaaatagaggaatatttcccaacttgttttcgaagccagcataatcctggtaccaaaaccaaacaaggacattataagaaaagaaaatatagaccaatattcctgttagcatagacatgcaacagctaaccaattttagcaaaccaaacctggtaatatagaaaaaaggataaataggccagtcgcggtggctcacgcctgtaatcccagcactttgggaggctgaggcaggcagatcacttgaggtcaggagtttgagaccagcctgaccaacatggtgaaaccccgtttctaataaaaatacaaaaatcaggctgggcacggtggctcacgcctgtaatcccagcactttgggaggccgaggtgggcagatcacgaggtcaggagttcaagaccagcctgaccaatgtggtgaaacgccatctctactaaaaatacaaaaatcagccggtgtggtggcacctgcctgtaatcccagctactcaggaggctgaggcagaattgcttgaacccgggaggcagaggttgcagtgagccaagatcgtgccactgcactccagcctgggcgacagagcaagacttcatctcaaaaaaaaaaaaaaattagctgggcatggtggtgggcacctgaaatcccagctactcgggagtctgaggcaggagaatcgcttgaacccaggaggcagaagttgcactgagctgggatcacaccattgcactccagcctgggcaacagagtgagactccatctcaaaaaaagaaaaagaaaaaggataaatacattctaaccaaataatgtttatctcatgattgtagctgattcaacattcaaaaattggcctggtgcagtagctcaggcctgtaatcccaacattttaggaggctgaggcaggaagatctcttgagcccaggatttcaagaccagcctgggcaacatagtcagactggtctttactggggggaaaaaaatcagtctgtgtaattcaccacattaacaaagggaaacataaaaaccctatgatcatttcaacagatgtagcaaaagcagttaatgatattcaacacatatgcatgattacaaaccaaccaacctcctagcaaactagggaaaggaaacttaacctagtttgataacagggcgtccacagtcggagttccactagcagcatacataatggtagaaaactcagtgctgccgggcgcggtggctcacgcctgtaatgccagcactttgggaggcctaggcgggcggatcacgaggtcaggagatcgagactgtcctgactagcatgctgaaaccccgtctctactaaaaatacaaaaacaaaaaattagccgggcatggtggcgggcgcctatagtcccagctactcgggaggctgaggcgagagaatggcgtgaacccgggaggcggagcttgcagagcctagatcgtgccactgcactccagcctgggtgacagagtgagacttcgtctcaaaaaaaaaaaaaaaaaaaaaagaaaagaaaactcaacgctttttcctctaagatcaggaactagaaaaggatttgactctcacaacgttgataccatactggaggttttaaccaggcaagaaaaagaaataatgagggccgggtgcggtggctcaggcctgtaatcccagcactttgggaagccgagacgggtggatcacgaggtcaggagatcgagaccatcctggctaacacggtgaaaccctgtctctactaaatatacaaaaaattagccgggcgtagtggcgggcgcctgtagtcccagctactcgggaggctgaggcaggagaatggcgtgaactcagggggcggagcttgcagtgagctgagatcgagccactgcactccagcctgggcgacagagcaagactgtgtctcaaaaaaaaaaaaagaaaaagaaataatgattagtggcccgatgtctcacgcctataatcccagcactttgggaggccgaggtgggcagatcacctgaggtctggagttggagaccagcctgacaaagatggtgaaacctcgtctctattaaaatattaaaaaaatagccaggcgttggccgggtacagtggctcatgcctgtaatcccagcactttgggaggccgaggtgggtggatcacctgaggtcaggagttcaacaccagcctggccaacatggtgaaaccccatctctactaaaaatacaaaaattagccgggcgtagtggcgggcgcctgtaatcccagctacttgggaggcttaggcaggagaatcgcttgaacctgggaggcggaggttgtagtgagccgagattgcaccattgcactccagcctgggtgacaaaagcaaaaactccgtctcaaaaaaaaaagaattagccaggggtagtggtgaacgcctgtagtcccagctactcaggaggcagaggcaggagaatcacttgaacccaggaggcagaggttgcagtgagccgagattgtcccattgcactccagcctaggcgacaagagcaaaattccatgtcaaaaaaaaaaaaaaaaaaggaaagaaaaaaaataacgattagaaaggaagaaataaaacacattcacagccagtatgattctatacatacatgtcctaatggggccaggcgtggtggctcatgcctgtaatcctagcacttttaggaggctgaggcaggtggcttccctgggaccagcctggccaacatggtgaaaccccaactctaataaaaatacaaaaaatcagccaggcgtggtgacgggcacctctaatcccagctactcaggaggctgaggcaggagaattgcttggacctgggaggcagaggttgcagtgagccgagatcgcgctattgcactccagcctgggcaacaagagtgaaactccggcagggtgtggtggcttacgcctgtaatcccagcacttcgggaggctgaggcaggccgatcacctgaggtcaggagtttgagaccaacctaacatggtgaaaccccgtctctactaaaaatacaagaattagctgggtgtagtggtgggcgcctgtaatcccagctacttgggaggctgagacagaagaattgcttgaacccaggaggtggaggttgcagtgagctgagatcatgccattgcacaccacgccgggcaacagagcgagattccgtctcaaaaaaaaaaaaaaagagtgaaactctatctcaaaaaaaaaaaaaagtcctaatggaaaatccataaaaagctaccaaaactaataaataaatatagcagggttgcaggttacagggcaatatagttatccctctatctgtaggggcttggttctgggactcctcacacaccaaacccacagatgtctaagtcccatatataagacggtatagtatttggatttaacctacacatatcctcccatatagtttaaattatctctagattacttacattacccccatacaatgaaaatgctaatgtacatgcaagtatgtatgtaagtacttgtactatattgtttagggaatcactggacatataggccttcaagactgataccagcagccactgttaagattctggtcaggcctgcccctgtttggggtctcagttgatctcattgccttcccacccagccaagggcacctgcatttctcttggctccctggccatttggaaggcctagttcagcctggcacatttgtatcctggcccactgatgctggtacccctgggaaggtcctgctctgaaaaacacggagattttagttgctactgaagatttgagagataaagacagggagacctgtctgtagacctgtgtccctccaagtgggattgagactttgggccccccatttcaggacagcacctcctggcctgttgactgaatagatccctgaaggaggtgtacttgcattaatggagtgggggtgggagcagtaccacagatccgcactaacaatcacacagttctctctagaataataatatagaacaagtgaaatagaacaattgcagaaagagctaacctttgttgagctcttactgtgtgcccagcactttcctcaactctacatttcccataatacacagagtactaggtaggccaggcttggtggctcacgcctgtaatcccagcactttaggaggccaaggggggtggatcacctgaggtcgggagttcaagaccagcctgaccaacatggtgaaaccccgtctctactagaagtacaaaattagccaggtgtggtggcacatgcttgtagtcctagctactcagcaggctgaggcaggagaatcatttgaatccgggaggaggttgcagtaagcggagatagtgccactgtactccagcctgggcaataagagctgagactccgtctcaaaataaaataaaataaaataaaataaaataaaataaaataaaaaaagaaaagagcctgccattaaaggagctgtttggtaggggatgttttgtcagtgcaaacaacagaaaagtgggctgggcacagtggttcatgcctgtaatcccagcactttgggaggccaaggcgggcggatcacctgaagttgggagttcaagaccagcctgaccaatatggagaaaccccgtctctactaaaaatacaaaattagccgggcgcagtggcgcatgcctgtaatcccagctactcgggaggctgaggcaggagaatcgcttgaacctgggaggcagaggttgcggtgagccgagatcgcaccattgcactccagcctggacgagagcaaaactctgtctcaaaaaaaaaaaaaaacagaaaagtgtaacaaacacttacagtaggcatgtttcttagcaaatctgatgacaaatttggcataaagaaagagagcatccctgaaaaaaaaaaaaagaaaaagaaagagagcatcctgcctgggcaacatagtgaaaccctgcctctacaaaaaaactcaaaaattggccgggtgcagtggctcacacctgtaatcccagcactttgggagtcggaggcgggaggatcacctgaggtcaggagttcgaaaccagcctggccaacatggcaaaaccccatctctactaaaaatacaaaaaattaatcaggcgcattggtgggcgcctgtaatcccagctactcaggaagttgaggcaagaggatcgcttgaatctgggaggtggaggttacagtgagtcgagatcacaccactgcactctagcctgggtgacagggcgagactccgtctccaaaaaaaaaaagaaaaagaaaaagactaaaaaattagccaggcaggcctctgtggtcccagctacttgggaggctgaggcaggagaatcactgagcccaggagtccgaggctgtagtgagccatgattgcaccactgtaccctagcttgggcaacaaagcaagaccctgcctcaaaagaaaaaagaaagaaagaaagaacatggcgggccaggcacagtggctcacacctgtaatcccagcgctttgagaggccgaggcaggtggatcacaaggtcaggagttccacaccagcctggccaacatggtgaaaccctgtctctactaaaaatacaaaaaatcagccaggcatggtggcaggggcctgtaatcccagctactcgggaggctgaggcaggagaattgcttgaaaccagaaggcagaggttgcagtgagcctagactgcaccactgcactccagcctgggcgaaaagagccaaactccatctcaaaaaacaaacaaaaaaacaaaacaaaagaaaacatggcaaagcctttgaaagcttgtctgggagaaggtgcgatgatagttgcataacttcgtgcaagatgctggtccacacaggggctgccccttgctctttctcgctctcttaacctctcatataacaggcttgtgtgttattcacatttattgagcccaagcaggtgcaaggcattgtgatctaatactttggtcagcaagacaacaagatagatcactgccctgcccttaggaagtgtatatgctattagaggaaacagataaaataaacaaggaaaagtatcagacaatgtaagtgctatgagaatgcaaatgaggtgatgtgaattaaaataggatgacttaaagtctgcacgggaaggagcctacccccatgttcctggctagccaaggaaccaccagttgattagcagagaagggcagccagtctagctagagcttttggggaagagggagtggttgttaagagatgagattaaagaagccgagacgggccattcgtgaggggtttgtaatgcagggctgaggagtgtccgaagagaatgggcaggtgagcggtgagacagttgttcttccagaagctttgcagtgaaaggaatcaaagaaatggagccgtgtatcaggtggggaagggtgggggccaagggggtgtccttccccatacagagattgcaggctgagaatgactatatccttgttaacaggaggtgggagcagggcacggtagctcacacctgtaatcttggcactttaggaggctgaggcgggccgatcacctgaagtaaggagttcgagaccagcctggccaacatgcaaagccctgtctctactaaaaatacaaaaattagctgggtgtggtggtactcgcctgtaatcccagctactcgggagactgaggcaggagaatggcttgaacccggaaggtagaggttgcagtgagctgagatcatgccactgtgctccagcctaggtgacagagagagactccatctcaaaaaaaaaaaaaaaatacaggaagggagttgggaatagggtgcacatttaggaagtcttggggatttagtggtgggaaggttggaagtccctctctgattgtcttttcctcaaagaagtgcatggctggtgaggggtggggcaggagtgcttgggttgtggtgaaacattggaagagagaatgtgaagcagccattcttttcctgctccacaggaagccgagctgtctcagacactggcatggtgttgggggagggggttccttctctgcaggcccaggtgacccagggttggaagtgtctcatgctggatccccacttttcctcttgcagcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtcagtgtttttttatagtttacccacttaatgtgtgatctctgactcctgtcccaaagttgaatattccccccttgaatttgggcttttatccatcccatcacaccctcagcatctctcctggggatgcagaacttttctttttcttcatccacgtgtattccttggcttttgaaaataagctcctgaccaggcttggtggctcacacctgcaatcccagcactctcaaagaggccaaggcaggcagatcacctgagcccaggagttcaagaccagcctgggtaacatgatgaaacctcgtctctacaaaaaaatacaaaaaattagccaggcatggtggtgcacacctatagtcccagccacttaggaggctgaggtgggaagatcacttgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctggagagacgacagggctggttgcccagggtccccaggcctctgattcctcactgattgctcttaggtctggcccctcctcagcatcttatccgagtggaaggaaatttgcgtgtggagtatttggatgacagaaacacttttcgacatagtgtggtggtgccctatgagccgcctgaggtctggtttgcaactggggtctctgggaggaggggttaagggtggttgtcagtggccctccaggtgagcagtaggggggctttctcctgctgcttatttgacctccctataaccccatgagatgtgcaaagtaaatgggtttaactattgcacagttgaaaaaactgaagcttacagaggctaagggcctcccctgcttggctgggcgcagtggctcatgcctgtaatcccagcactttgggaggccaaggcaggcggatcacgaggttgggagatcgagaccatcctggctaacggtgaaaccccgtctctactgaaaaatacaaaaaaaaattagccgggcgtggtgctgggcacctgtagtcccagctactcgggaggctgaggaaggagaatggcgtgaacctgggcggtggagcttgcagtgagctgagatcacgccactgcactccagcctgggcgacagagcgagattccatctcaaaaaaaaaaaaaaaaggcctcccctgcttgccacaggtctccccaaggcgcactggcctcatcttgggcctgtgttatctcctaggttggctctgactgtaccaccatccactacaactacatgtgtaacagttcctgcatgggcggcatgaaccggaggcccatcctcaccatcatcacactggaagactccaggtcaggagccacttgccaccctgcacactggcctgctgtgccccagcctctgcttgcctctgacccctgggcccacctcttaccgatttcttccatactactacccatccacctctcatcacatccccggcggggaatctccttactgctcccactcagttttcttttctctggctttgggacctcttaacctgtggcttctcctccacctacctggagctggagcttaggctccagaaaggacaagggtggttgggagtagatggagcctggttttttaaatgggacaggtaggacctgatttccttactgcctcttgcttctcttttcctatcctgagtagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgaggtaagcaagcaggacaagaagcggtggaggagaccaagggtgcagttatgcctcagattcacttttatcacctttccttgcctctttcctagcactgcccaacaacaccagctcctctccccagccaaagaagaaaccactggatggagaatatttcacccttcaggtactaagtcttgggacctcttatcaagtggaaagtttccagtctaacactcaaaatgccgttttcttcttgactgttttacctgcaattggggcatttgccatcagggggcagtgatgcctcaaagacaatggctcctggttgtagctaactaacttcagaacaccaacttataccataatatatattttaaaggaccagaccagctttcaaaaagaaaattgttaaagagagcatgaaaatggttctatgactttgcctgatacagatgctacttgacttacgatggtgttacttcctgataaactcgtcgtaagttgaaaatattgtaagttgaaaatggatttaatacacctaatctaaggaacatcatagcttagcctagcctgctttttttttttttttttttggagacagagtctcactctgtcacccaggctggagtgcagtggcgggatctcggctcactgcaacctccgccttctgggttcaagcgattctcctgcctcagcccactgagtagctgggattacaggcacctgccccgacgcccagctaattttttgttatttatttatttttttttttagtagagatgaggtttcaccatgttggccaggctagtctcgaactcctgaccttgtgatctgcctgccttggcctcccaaagtgctgggattacaggcgtgagccaccgcacccggcctgcctagcctacttttattttatttttaatggagacagcatcttgctctgttgcccaggctggattacagtgatgtgatcatagctcattataccctcctgggctcaagcaatccccctaactctgcctccccagtagctaggaccacaggcatacaccaccatacccagctaatttttaaaattttttgtagatagatagagtctcactatgttgcccaggctggtctctagcctacttttttgagacaaggtcttgctctgtcacccaggctggatagagtgcagtagtgcagtcacagctcactgcagcctccacctcccaggctccatccatcctcccagctcagcctcccaagttgcttcaactacaggcctgcaccaccatgcctggctaatttttatttatttatttttattttattttattttatttttttgagactcagtctcactctgtcgcccaggctggagtgcagtggcatgatctcggctcactgcaacctctgcctcctgggttcaagtgattctcctgcctcagcctcccgaatagctaggactacaagcgcctgctaccacgcccagctaatttttgtatttttagtagagacagggtttcaccatgttggccaggctggtctcgaacttctgaccatgtgatccgcccgcctcggcctcccaaagtgctgggattacaggtgtgagccaccacgcccggctaatttttatttatttatttaaagacagagtctcactctgtcactcaggctagagtgcagtggcaccatctcagctcactgcagccttgacctccctgggctccggtgatttcaccctcccaagtagctaggactacaggcacatgccacgacacccagctaattttttattttctgtgaagtcaaggtcttgctacgttgcccatgctggtatcaaacccctgggctcaatcaatccttccacctcagcctccccaagtattggggttacaggcatgagctaccacactcagccctagcctacttgaaacgtgttcagagcatttaagttaccctacagttgggcaaagtcatctaacacaaagccctttttatagtaataaaatgttgtatatctcatgtgatttattgaatattgttactgaaagtgagaaacagcatggttgcatgaaaggaggcacagtcgagccaggcacagcctgggcgcagagcgagactcaaaaaaagaaaaggccaggcgcactggctcacgcctgtaatcccagcatttcgggaggctgaggcgggtggatcacctgaggtcaggagttcaagaccagcctagccaacatggtgaaaccccgtctctactaaaatacaaaaattaaccgggcgtgatggcaggtgcctgtaatcccagctacttgggaggctgaggcaggagaatcgcttgaaccaggaggcggaggttgcagggagccaagatggcgccactgcactccagcctgggcgatagagtgagactccgtctcagaaaaaaaagaaaagaaacgaggcacagtcgcatgcacatgtagtcccagttacttgagaggctaaggcaggaggatctcttgagcccaagagtttgagtccagcctgaacaacatagcaagacatcatctctaaaatttaaaaaagggccgggcacagtggctcacacctgtaatcccagcactttgggaggtggaggtgggtagatcacctgacgtcaggagttggaaaccagcctggctaacatggtgaagccccatctctactaaaaacacaaaaattagccaggtgtggtagcacacgcctgtagtcccagctactcgggaggctgaggcacaagaatcacttgaaccccagaggcggagattgcaatcagccaagattgcaccattgcactcccgcctgggcaacagagtgagaccccatctcaaaataaataaataaatatttttaaaagtcagctgtataggtacttgaagtgcagtttctactaaatgcatgttgcttttgtaccgtcataaagtcaaacaattgtaacttgaaccatcttttaactcaggtactgtgtatatacttacttctccccctcctctgttgctgcagatccgtgggcgtgagcgcttcgagatgttccgagagctgaatgaggccttggaactcaaggatgcccaggctgggaaggagccaggggggagcagggctcactccaggtgagtgacctcagccccttcctggccctactcccctgccttcctaggttggaaagccataggattccattctcatcctgccttcatggtcaaaggcagctgaccccatctcattgggtcccagccctgcacagacatttttttagtcttcctccggttgaatcctataaccacattcttgcctcagtgtatccacagaacatccaaacccagggacgagtgtggatacttctttgccattctccgcaactcccagcccagagctggagggtctcaaggaggggcctaataattgtgtaatactgaatacagccagagtttcaggtcatatactcagccctgccatgcaccggcaggtcctaggtgacccccgtcaaactcagtttccttatatataaaatggggtaagggggccgggcgcagtggctcacgaatcccacactctgggaggccaaggcgagtggatcacctgaggtcgggagtttgagcccagcctgaccaacatggagaaaccccatctctactaaaaatacaaaagtagccgggcgtggtgatgcatgcctgtaatcccagctacctactcgggaggctgaggcaggagaatcgcttgaacccgggaggcagaggttgcggtgagctgagatctcaccattacactccagcctgggcaacaagagtgaaactccgtctcaaaaaagataaataaagtaaaatggggtaagggaagattacgagactaatacacactaatactctgaggtgctcagtaaacatatttgcatggggtgtggccaccatcttgatttgaattcccgttgtcccagccttaggcccttcaaagcattggtcagggaaaaggggcacagaccctctcactcatgtgatgtcatctctcctccctgcttctgtctcctacagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 193384 - DNA, 5572 bp, homo sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcaaaaaaaaaaaaaaaaaaaaaaaaaaa

SEQ ID NO: 193385 - DNA, 105338 bp, homo sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggctggcacatccagggacccgggccggttttaaacctcccgtgcgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctgtatccatttctgcggctgctcctctttacctttctgtcactctcttagaacgtgggagtagacggatgcgaaaatgtccgtagtttgggtgactataacatttaaccctggtcaggttgctaggtcatatattttgtgtttcctttctgtgtattcaacctagggtgtgtttggctagacggaactcttgcctggttgcaagtgtcaagccaccgattgctttcttaggctatctatatggtctcttcctgagggctattgtccgttaatacagaatacagtacactgttagtggattagcgagctcggtaatccggtctcctaaatgaacaaaaaagtagacgctttttgaggttgagcatatttcgattaaatcttggcttaggccctagatcaagggtttagatcagaataaaatgaaaattagtgttgcacgtacgcatattgcatcagaatcttgcagtgattgttttagtttcctgagttgcattgatagattcttttaaaatatgactgatttgcataactttagaagcagaatcattttcagtatatatggtgcacattgagggcaaaaagtagttttgttaatgtttaaacttaagttacctacaactttgaactgtatgtagaagttttgtagtttgaagtcaatagtgccataatataccttataaggcgttcttactagatctttgttatatttacctttttctctccctatggggtgatgtaggatagtgcttgaaatttgcacttcagtagcatttaatgttcagtgctcttgtcataaacatagaatggatattgagtagtttctgatcccagatggtaatgtgtaggttcaagggtattgtgtgtagcaagtgaagattgcagaaataaaacttcagttcatgcttgaaatttaagtattgttgtgatgccagaattgctgctcaccgtttttaggtttcaggtcctctgacaccttttggtatcgttaattttactgatttgtgtagaatgtcagttgtattttaccagctaatatctagaaatgctggcaagaggggtttactccagctttagattgtaggtatgttagcttttttcatacagtgtattaaatttactgagtcagcttgctgaataagacagaagcccaagaattttaacagtgtgtagctttagttgtctaaaagttaggccttcgggcttcaaaagttagtggtcatcgaaaagcattaatctttgcagtttcaggtacaacacattggttttgattagggatggggatggggccctctttttgcagaatggggaaagtattgacaggaattgagagctattggtaggccagtgtataaggtatgtgaaaacagaattaagttattggtctgaagtgactgaagcatttaggctctatcaaggcctaaaatttggtaatatgagtttggtaatgcgaattgtggcagtggacaatatttagttaaaattatgtaattgcataagtactagcacagtatttttaataaaagttatttcttagcaaatgtcagttgcattttgtctaaaggtagagtgacactacagtgtctatatgtcctgctaaaaattgtggggaatatttttttttaagacagcgtttatatcgggagaggttttattccgttggattatgttagctgcatataaatgtgcacagttaattttgcccaagtttttgttttgaaatgaatgtaaaacttactgaagaagtagcttcccaaaatttagttttctgttaagccaaaaatattattttaaaagagtatttgcaaattttgaagttgacattaattgagaatgttactaaggctaaactggacccgcttgcccagaagataattatggaaaaattcttttgtgacttccaaagcagtctactattagcatgaattactgacagtcatccaaatatataggaacaaaaaattaaatgtttatgtaactttgaaaaaaaagcctttgaagaaaataattgaatgctgtctgggagacagatttctttcagcacttaaagtacataacacactacttttacttttcccacttgattttaaattatcagggttattaagaccttaaaattattttaccaggtttttacatgtgagctgtgacatgactggcattttctttgatttcagcgtatgttggtctctacacatgaaatttgtgtgacttaaaactttctctaaaactgtacttttagttatgatatgcatagaaagcagtatcaaatattgcgtcaaatgactaataacacttaatttctagagttgtggttttattgagccaaaagttgatatgaaaaaaagtcagtaaggaaagtcagtgaagtgcttgcttttttgataattgcactcccaataattttgatattccaacgtacttggtttgcttgttttcacgttaatgttttctgtttattggagtgggaaggcattaaaattgtcattgaagactttgtctttgacatgttgtagtatttatttcagtaactaacctgtgaaaagttaaattcctttatgaaagtagtgattggagtatttttatctgataaagaaagattaataatgaagccatttctccgaggaaaattgaggacaataattcagttttaaaatattatcgcaaaattaaattattctaaaaatttgttagtagggttatatgcttaatattagtctgaaatatagtgctgaatttgagactatagaaaaattaagtgtatttagggtatgtggaaacgttaggcttctgttgtatttttattgtttggtagatttgcctcttttcaaataaatgttcacagggaatacttttaacttgtagagagtacagtgactattgaagttacctaaattacctcaaggtaagtgattactgaaattaatcatgagggttttaaaaagtattctattcacaacatttattttacattgttttgtatctgctaagttatatttcctgaaaaacatgactggaccacctaattgctgtatgataacttacaaacttcatttttcatagtgcttattcaagtgtaaagcacaactgaaaggagtaatgtacagtttatatgaggaaaaaggaattttattgctgccagtgtaaaagtttgcacagcagtatagtcatcaatgcagatttacattgcttataatatactaagtaaatactaaatgattaaagataataaaatatggtgaggtataaccaccttcattttaaacttagttttagaagatagtaaagaaagattcctttattacctttttagaattttatttttaataacatgggaaaggcaactggtgatattttaatttttgtatggaacagtgcatctgctttctcatagccacataaaatacataaacttcttagtgttatgaaatggcttactttttggaagtgaagaagtcttcaattcttattttctaatgttattttgaaatttgcctccatttgctgtttgttcatttggtgatagcgcaacacttaaaaaaatattttaagccgcttctgaagtaatcacttcagtgacttttaatggaggagtatttgttatgggaaattcacttcacaaagttttaacattaattcacttgaagtaaacgtgctatttttaaattttcatctcaatcttttaagtaagacgaaagcttaggaaatcacttttattattgatattgtgtgtgacttcagagtttgtaaagagaattgtagaagtgttgcatgcatatgacaattttctgcttaattgaaatgtgaggcctctgccatactacaaggatttagcttccagaaaatgtaatattaacatagcttaagaaatgtatttttttttttctgtagaaaccgttgggttaaacaaacagttcagaagttttattacatggaacccattagttcttaatcttgttacctttttcttcattttttctgttaaacttgattttcacagtcagcattgaagaattcatcttgtggcctgaattcattaagaaaagatgttaggatttgttctgaagatagtgacttaggaaatttgtgagactggggtcagtcagttctgttttacaattgctttctatttggtagctttgaaattaatttagttgcttatcagagagaataatgttgaggttagactaaccttaaattggtaaggctttgctgagcaaactgataactgtaagtcttttatagggtgcattactgccacatatacgttcttccataggtggttaaaagtatattggtctgtgtttggtgattctctttgtacatattgagtatatgcattcactaatgtaaaataatttgccaagaaaggtgaaattagtatattgtacttgactattcacctttcccttagttttttgaatttttttcattggttgcagaggaagtattagcaatttaattcttttaaaataatttgcactggaataaataagtatcggcaaatataagaagagtaacataatttaagggtgaattaattttatttgggaagttttagttctgtatagttaaggcagattcttcatttgcaacagttgacattgggacatgtgtgaacatcttcaaggtattaggacatcttcaaggcattactttttggcagtgttgagaatttttttttttttttttttttttttgagatggaatctcgctctatcgcccagtctggggtgcagtggcaggatctcggctcactggaacctctgcctcccaggttcaggcgattctcctgcctgaacctcccaagcagctgggattataggtgcatgccaccacgcccagatagtttttgtacttttagtagagatggggttttaccaccttggccaggctggtctcaaactccagacctcaagtgatccgcctgcctcggcctcccaaaatgctgggattacaggcgtgagccactgcgcctggccagtgttgagaatattgagagatggatattgtagctgtacctgccatcaaaagaattttcttgacctccacatagtgtgaaaaagaagactgtttacacattatattttaagtaattatacacataattattatcagtactcaccacttcaaatatgaacagtgaatctaaccagtgtttgatttctctgtgtgtgtatgtgtatacaaagttagcaaaccttttatcttaatatttattaaaaaacgaatttttgtttctttaaagaaaagactaccttagagaatattgttctatagtttttaaatatggtcagatctattttaaattatgttaaaattttgagtattacgtttatctatacttttaagcatatatacattgtttcattttagattttagggaggcagtgtgggctctggagccagactgcttgttttgtaatcctggatcttccatttagtagctggatgactttgagtaggttatttagattttctcaatctattttatctgtaaaatggggatgataatggaacctaccgcatacgtttatcttgaatagtaagtgagataataataagtaatttcatttagcatagtacctgccacattgtaaatacttaaatggtagctactgctctgaaaaactgtaatttcaggttatgtatgtagggaaattatttgtattttcatttatggtgtatgattgtaactgaatttcctcagtttgggccatgttaggattttgtttcaagttataagtgtttttaaaaataagggtattcctttaggaagtctgggtatgacatgtctgtgattttgctggttcatcacaaatgggaaataaatctctgctaactcaaactgttgaccaaagtaaaattaattatgccaatcaaaaactatttgctttaaaatataaaaggcaaaaacttcctattagcataatgaagtagaatttttaaactttgttataatcttaaattttctttagtgttgaagataggtcaacttaactatcatacatttttattcacataaagtaaactctgcctcaaatgtaataaacttaatatgagttatgtaaactttggtcaatagaggtatattttttagcatttccttttgaaaatttcagccttttgagggagtcttgcaactgaatgtcaagttacatttattacaataaaatggacacttaatataatctgtaatgcattaacataatatgggaacttttaaagtattcagtctctgtattattgagtcctatttccacatttggccaggattctcaatatgatttaggcccaagacgtgggaagaaagaagtaaagaactaaaggatttttttcttcatttttttaattgaatatggggaaagatggaataagcttatctgtccagtaaaggccattatgtgtacatagggattattatttttcccccccttgggctgtactgatttcccagatgtaccacagcactcttagtagtgaagcacttgacttctagtgagtggattttttgtgtgtgtgttttatattgcagagtgaatacactctgtctgatactatgtgactttctgattatgtgatttttatgcattttatgtgttttgtaaactagctgtatttttggtccatgtctaggttgtagaattgaattgtgcattttggcatctgagcacagctgagttttctaaatcaatctctctccttgcacctagtttttgctttagatcactacctaagacttactgttgatttaatattagagcacttaagcatagctttgacttttatttcctttgatttttgtagattttcaggctgaagtacaataaggttctctgttctttactagtaattgcaaagattgtattctgtgaattttatttgtttaatacttttgatcttttgaagaggatgtaattatttaaggtattatgaaatgcattgtgatttgaattagatactctttggagatggagttttgctgttgttgcccaggctggagtgcaatggtgtgatctcggctcaccacagcctccgcctcctgggttcaagcaattctcttgccgcagcctcccaagtagctggaattacaggcatgcgccaccacgcccggctaattttatattttttttttcagtagagatggggggtttctccatgttggtcaggctggcctcgaactcttgacctcaggtaatctgcctgtctcagcctgctaaagtgctgagattacaggcatgagccactgcgcccggcctcagatactcttttaattagatgcgtttaaaaatttaacccaccattgctggcatgaatagatgtatttttagagtgattcataaatatcgtatacatgtttaaagttacaaactttttgcttatttcaaaatgcaggattcttttccatttaaaattccctctctttgtgagacttctttttgagtattctggttactctaaactgattggagatgaaattagatagaattgaaaactgtacttttaaaatgaaattttggggatgtcattaagcttgattttttaggttttttttttagtgtgtattataaattattttacactgattgtcagcgataaaatggaatgcctgggattttttaaaatttattttattcatttttataaggtaaaaacagtgttttgctaggcttaatttgaccatgttgtaaaatttattgtataccttgaaagaatcatttatgaaagatactgaattagctaatatatactctgtcttatgtagtttttgattaacaatacactttttaaatcattagctcatttgattttgcaaagaagaacaggtaacctaagaggcagacagaacaggcattacttttatttttctttcttttttattttatttatttatttatttatttattttttgcagcttaggaattgtagctccagtggaatcagtatcttgttaatggctagtgaaagactgagtctgaagaaggatgcaggacttttttggcacttggtgcagtatttttcccattatgttacatgagtggttcttaaacttcagtgtgttagaacaacctgaagggcttattaagctatggattgcttactccaccctcagagtttctgattcagtaggtctggattgggacctgagaatttttatttcttagaagttttcaagtgatgctgatgctggtgctctggggatcacactttgaggaccaccaatgaacattatctcccaccaagcaaacccttaacatgttatactcctttaggttattagaatttatacatgcattatttcatttgacctgtaaactctaagtaactttgcatggaaaatgttatcctgattttatagacgagatagtgagtttagaaaggcagtatggtggaatggagcatagatttggagttggctagacctaaagtccagattaaatctctgctcaaggctgggcgtggtggctcatgcctgtaatcccagtgctttgggaggccagcgttggcagattgcttgagtctggaagttcgagaccagtctgggcaacataggcagaccctgtctctacaaaaaaaaatacaaaaattagtcgggtgttatagtgcgcattggtagtcccagctactgaggaggctgaggtgggatcacctgagactgggactttgaggctgcattgagctgtgattgggacactgtactcctgcctgggtgacagagtgagaccctctctcaaaaataaataaataaatacatccccgctcagccacttatcagttacgtagatacactgcctaaccttagtgaaccctgtttcgacaactccaaaatgggagtaaaaatcctaaacttgtacagtggttttttagttttgttaaaagtacaggtgaggtttttttcagagtattggttgccatctgagagtgatcccctttcacctcctctaggacttttagcattttctggagacattttggtggtcacagctggggtggtagagtgtgctattggctaggggcttgaagccagtgatgctgcttaacatcctatatggcacaagacccctccccatcaacaaagaattatctagcccaaaatgctgtgtaaaatgtctggtatataataagtataatatttgatgaaaatcagtacctttgcccccaggtgtgatatttaagaaggtcaacttactaaatcagtgatggagttagtcctaacatctgggtgttctgactgctgctaggccagtattctttatatgataataagaactttgtccacagaagatatccctaataacaaaaaaggtttatttgaagaggactcatgtgttctttggctgattgtgaaagtgttgctttgaacttctgttagaaaaggttgaagatgttttccgtaagtgtttttaatactgtacgtagtattcagaaggatgtttaattttttttttaattttgctagtagtttttaaagtaatcctttttcctttaattatgtagttgttgaactgttgggagttacttttctcttactattttgttatttaatgtattctttgaccttatgcttttttattctaaagctgcttttattatagtcagatatgatgaagttaaatgtacaatgtaaaattgcaaatttccaacgagctatacaaacttaaatatttctaagtaaagaaaatagggctgactctaaggttctttgatccatgtgttgcattcttttctaggccctaaatttgctatgccagcctgttgaattaaagtgctttatttatctaaattagaaacttgtattaaagtgaagttttagaaaaaaagaaacaaaatcggaatggagttttaggttagcccagagatgggaagatgccaagaaggtagctttagtggattctgaattttttggttttgttttgtttttagggcaggcaaatgtaattacaaaagggttctaggaatagattgctgtgattttttttctgtttgcatgattttacagtttgctttgcctctcacttttgaatgcagaataaaatgtcaaggccttatttttttttaaattcttaagaaatttaagatttgactgttaattccttttgaaatatgggatattttgagataccaattatttaagacaaataggactcattgttacaattcagttgaataaggcttatgatgtttatttcagtatatgaatgaaaactatgtgcttattgtacttaagaaaatttcttttattaaaaacatgactaaagagaattttaaaaatcacccactgtcctacttctctaaaacttaatgttttcatattagcttccagttttgttcatatgcatatactttaaaacctagttcatggtgaacttaagagggtgttctttttaaaaaacaatttccattgcactttgtcgttgccttaattaaatggtgaaatcatcagaaatatttattttcctatacttatacatttattaagcttgtttccatttttttattttgtgattttttaagtggatttaagataacctaaacattagagaggattttcatggttttgattcatgaaatcataatgttatacaaacctaactgaagtgttagagccttgaagatttttcccccgaattacatatagtaactctacttgtatttaatactgaaagcatattttacttatttaagtgagacaaagtaaaatttagctgaatactttagatctatcatttccttttcctgttgtaagaacattacattgtgttgaaattaaagtggatatagaaggtaattagaataaactgccacatcatttttatagtaaagtggtaataacactattgctttctgtttttttaatcagaaggagtatgggcttataatgatgttactgttccctgaagcatattttgaatgatacggtttatatttgcacagttgcccaggtaatcattgtgatattaattgatcaatttgctatttatttgcgttttaaatcagtactagtatttgtgcttaaaaattttgcatatgttttatcagatttaatttttaagtgtcagatactaaaacaaataaccttaactttattaaattataattttttatcatgaggtggtattcatttattcatatagttagaacaaaaaatatttaaaatattgaggtagaaacaaattagtctctttttaattaaaagccagattacttgttagagtaacattttcccaaatgaggtaaaattgttgcgactgttaaacttaaggaaattttgatctaggtgtggtatataccttcttgtggggtgctaatgaaaacagggatggcaaaaatattttgtttgtgagtgtatgcatttatgctttttgacaacctaagaaacactcttacatctgagtatctttcatggactagctgtaggaaatctatataaaatagcttagtatactgaaagtatgacatagttttacatatctagattgtggttgtgattatatataatactataaaatatgctaacgtgctgcttaataatactatttggattttttttaatactgaaaaggtcacacagattgtgattattgtgtagtgtccaagaactaaggcctaccatctgttactcaaatgtatgaaaaagttaagataatttagtgatataagtggttttgacaccactgtttttggaataatctaattatgatttttataaagactaatatcaaattttaaacgtttgcaaaaatgaaacctaatagttatactgttatttatatttttctattacaatacagatactggctgagaactaaagattgtgtaataaacgcctggccttcagtcatttggttttttttttccctcgattgtttggatagttaactggacatcatgttttaacttgagaaattaagttatacaagattttgatattttaaactagttttcctaactggttgagatatataagaatttagtattacaggactcaatcagggaactgatttaataagaatttcttaaaaatttgtttaaatatttttcaagttcttttcttcatcttctacaacttaattcttgtctgtatgcaaatgagcttccccatttaaaattttgctgttgcattttaggccactatagaagttgtttctttaattttcactcacaagaatttggtcttaccaaattgtgtaaatctttaaaattgtgtatttggcttaatattatagaatctgattgatttaatctaccttgtttcatttagtatgttgacattttcttgagaaatttgttatgccaaatgattaacataataatattttaagtttagatatgattttgaatttacattttcaaatgcaactttgtgtctgtggccttttttttttttttttttttacgagaaacatcttgccaattttcagattaatctgtgaggaaagtagattggtttactagactcagtttgtagactttggtgagaactgaattggaggctatgaaaaaaataccttttgggcctttctgaatagacatatatacataaattatatctcttacattaagtgaggcacatatgtaggtgagatttttacctgaatattaaaagtttaaaagtcgttacctattctgtttacttaatagtatttaaagggtgtgagaggtgttatgtgtttctgtcccttgtttttattcctatccctcccatctaactgttggtactcttatcttcccaggtattaaacttgtatgttttaaaagcttatttacttgttgaaatggttaacttaattagttttttctttgaagtttcagcctaaatattttctgtttttttatatgtcctttaaatatgaaaattctacagctaatcataattagtaattgtactttttcccctattacaataactggtttcataataaaatggtatcccttcaataacaagcatttatagtagtttattaaaactaagggtgttatctattcaaaccaagcaatgcagacttactgttgactctgttaatatattttaaaattgcatattactaaaatttaaaatatgattttgactagtattttggtgtatgttattttagatattttgattatgcactacttaagaatgaattgtcaagtatgattataaagttgatataatagttaaccttcagtgggaataggaatcatttaatattgttagatatttgtattattagaacaatctcctatgattcttactaatatagtaatgaatgacagacaatatgttggctttcatatttaaaaattcacatgcatttctagtttatgtttttcttcgactaaaattctgcagcacttaggcaaagctatttttaccagttggaaaaaaagtaagtcatttccaaccaattttcctggcttgtagtatagaataaagagacttgattttattacattaaagccaaatataaaatgatgcaatctagcacacacttgtttggaacttttctcttttaaatattcagattaagaggacgttgaaaggtaaatttttttttttttttgagacggagtctagctctgtcacccaggctggagtgcactggcacgatttcggcttactgcaagctctgcctcccaggttcatgccattctcctgcctcagcctcccgagtagctgggactacaggcgcctaccacggtggcgcccggctaattttttgtatttttagtagagacggggtttcaccgtgttagccaggatggtctcgatctcctgacctcgtgatctgcctgcctcggcctcccaaagtgctgggattacaggtaaattttgattgttattagcaactataaaagttttgcagttggcttattggaaaaagaaaacctccttgccggagacggagacgcatttgtattagaactttgttttctgagtaccttacctatagtaggtttcaaatattggtgaattagttgatggttaggtctgcataattactgcgtatggaaattctggaaccctattttttcaaaatgcagctaatgttgagagaatatgcactaaatattactagatctttgtttttcaagatgctgatatcccttaacatcttctgcactttacctgtttgaatatcttttttgctgtaaaaattagtggccttatgtctttctgcataattatagagtagccaaaacctgttttaggttaatcacctctggcaaaataaatgataaaagcatagcttttgtaagcagaatgatattacagaagttaacttataaatctaagtgtattaaagacacttaggaaatttatgataatgctgggtcagcattacagttttaactttttacagtttttcatatgctttttttgtgattttgctgtagaaaattaacagttggcatttggcttagttcaagtataatgctgttgacaagtatatctgacacgtcattgaactaataatatttttgaaagctgataggtaagttatatctattttgtttcattcgtcattagtgatcggtcttagatgtttttagcgagagcaaaactgtagaggaatgtgtgtctgtgtgtgtatatgtgtgtgtgtgtgtgtgtattttaacagcaggagagttctgaaacaggaaaccagtcttatcatattcatccagagacctaggaagaaggtaattgtttggtatactcgttaaaaccagttggttgggcaacttaaatttttagaggatcacagatgtaggcttgagcagttgtagatagatgatttctttttttttctttcttttttcttttttttttgagatagagtctctctctgtcatccaggctggagtgcggtggcgcgatcttggcttactgcaacctctgcctcccaggttcaggcgtttctcctgtctcagcctcctgagtagctgggattacaggcgcatgctgccatgcccggctaattttttgtattttagtagagacggggtttcaccgtgttccccaggctggtctcgaactcctgagctcaggcaatctacccacctcggcctcccaaagtgctgggattacaggcgtgagccaccgtgtctggcgatagattatttcataattaacacctgctatgaagaaaaattgattaaaatagttgagaagtctagtacactctcagctaatatactaaattatactatggattttagagtattgttaacattatcagtgacttgatatcttcctgaggttctaatttgcttaactttaaataattggggttcagatcaccttgattgttcccttaaagattaaattttgtaaaactgtgtgtaattttcctgtatctggtttggatagctttaaaaatggttcttaagtttaatgagttcaactgggaaaaaagttagttctattttagatgttgtgtcactggaaattatgtttccctgtttgttatatgcacattattacaaagttgtaatcaatgttttcatactgttctctggtctgtttttttcacaaatacactttttatttgtcgccaggtacttatttttaaagctatagaggtaatatttcatcaggtgagggtaactaccatggtttgtttgctatactgtgttagggttattttcgttttttttttcttttataaactatagttgtgaatatgtttatgtagtttacttttggtttattagaatatattgctagagtgggattacaggattaaagagtgtacagtattttagttttttttttttttttacaagttgcagatttgttgccaaatgaacgagtttgtagtattgctaacaaggagaagaattactagcaagtcttgatgttacttttgaagagtgtgatgattgcatttaggaagatatctaaacttctgtttcaaagcaaaaagtatgtgcaaatttcttactcatgacaaattcatataatataaaaacatgaaagttgtgaggtcaggttgtttggagaagtagaaaacttcagtagagtttatagataggcagtcttcctttctggtttggcactgacagcagattaactagaaagtgttagaaggaacctaaaatttatactaaagtcaatttaagttaattaatataccagaattccttcttttacaatttatttataaaaacaccatattgagttgccttgtaatgagacatttaaactaaatttaaataacagaattcatgcaccatctaataacaaccccttatttacaattatagagtcctttgcaattttatagatattttcatgtatcccatttggtccttgaaacaattaatgaagaagttacagcaagtggtattatcattattttacagaagaacaaaacaaaaatatatgtggcccagagattgagtgatttacctgaggttataggctttagattgcatagctggaagtagaaccttgttcttctatattaaatgacaatattcattaagtacttagcacaggatttggtacctagtaaatatttaaatgttcctgtgttattcctgactattccttctttattcttaaaacgccattttttgagcactcttaatatttatagttcaaactttgtacctatgtacctttttctctttagaaaataagatttcaggctgcattaatttgatctgtacaggaatgattatatgttttacatattgggacaaattgctctttttttatataccttaagctctagggtacatgtgcacaacatacagatttgttacatatgtatacatgtgccatgttagtgtgctgcacccattaactcatcacttacattaggtatatctcctaatgctatccctcccccctccccataccccatgacaggccctggtgtgtgatgttccccaccctgtgtccaagtgttctcattgttcagttcccacctatgagtgagaacacgcggtgtttggttttctgtccttgcgatagtttgctcagaatgatggtttctagcttcatccatgtccctaccaaggacatgaagctcatccttttttatggctgcatagtattccatggtgtctatgtgtcacattttcttaatccagtctatcattgatggacatttgggttggttccaagtctttgctattgtgaatagtgctgcagtaaacatacatgtgcatgtgtctttatagcagcatgatttatactcctttgggtatatacccagtaatgggattgctgggtcaaatggtatttctagttctagatcactgaggaattgccacactgacttgaactagtttacagtcccaccaacagtgtaaaagtgttcctgtttctccacatcctctccagcacctgttgtttcctgactttttaatgatcactattctaactggtgtgagatggtatctcattgtggttttgatttgcatttctctgatggccagtgatgatgagcattttttcatgtgtctgttcgctgcataaatgtattcttttgagtagtgtctgttcatatccttcgcccactttttgatggggttgtttgattttttcttggaagtttgtttaagttctttgtagattctggatattagccctttgtcagatgggtagattgtaaaagttttctcccattctctaggttgcctgttcactctcatggtagtttcttttgctgtgcagaagctctttaggacaaattgttcttaaataatgaacagttggcactttttcaactggaaaattcaaggaactgctctttctgctttctgctcaatatgaatcttcaatttagaaatgagagtccatcattaacaattcaacatagcttattaataggaaaaaaaaacctagtaacaaatgtaaaatctttgattaaatgagaaagtcatagaagttcatcagatttgtatttaaagcatgatttcattagaaaagttgataataaggatttaactgtgacataattggaaaatacttgtttaaacttaaaattttgaaaagaaatgtaaatgtgatgtaacttatgaatcagtggttgagtttcttttttgctcacaagaaccctaactgtgtgttacttgaaagcactgatggaaatcagggaaaaagctccagaagttcctacgaaataaaattaaatgataaagtcctggtatctgctaacttgccttccattcctgttatcttttcttcttagtctgacttcattaattctttcaccctggctactggtttagctcagtgttttatgagccaggcagcttcagactttgcttttgatgctctttgttcattacctctaaagctgtattatcactttcattttatcattaatgtttcatgtatatgttatagtttcatattgttactgcaacttttacttagctataatttaaaaaatatctgtgatctgtggaaataattattctatggcagaaaagtagttattgcattttactttataagttgtttaaggataagcatacctatatattaagcactacaaagaaacttttacaatggctttatttttagcaaaccatcatagttaaaataagatttagtgtacatgtcaggaacacagtcttatgaaataaggtttagggagctatttttagttactatatcctacttgaaaattgtagttaaatttctagcatataccctattaatttagatgcaagtacagatttgagataaggtagatacattatttggatgtcaactcggaagttgttcaagaaaagatattttgttatttagatgtaacttggaacatatttctagtgtttcaagtcatgattgtatgcctagaacaggcaataaaaatttacttagctggtaaaacagccacattatttcaaatatagtttagttatattatggattaaattgatttttgtggacagactttagaacttaattgctattaattacattttttctttgggacggtatttgttctttggtgagaaaggattcttgtaacacctaaatcaagactgtccaaacatggcatatgcagtttaccagtcaaaacaaactaatcacttaagatctgtgtattttgttttatttgaattatacctcaattaaaacaaatttagcatgtttacacaaaggtggggggaaactgtctaatatatctgagatctgttggagctggggtgaccatccaacttaggcaagatagctagtaccatgtatgcatttcttttacctttcttattgtatatacagtaatcactgatattatgagaaaaagaactttttaataattcaggagatattttatcgctagtatatattgagtgcttattatgtgccttatatactttggactcatttaatcctcaacacaacaaccctatgtagttcatactagaattattcccatttaaagatggggaaagtgatgtttagagaggctaagtgacttgcccatggccaaagtattagaactgggatttgaacacaggtagcctgattcctaaataaatgaccactaacattaaaaagacataaacatagaggtgtttgttgcaatgttagtcataatacctaaaaattgtgaactagttaaatgtccaatagtagtaaaatggttcattaaccatggtacacccatcaatataatgttatattgtcatttaaaattgtattcccaagtttcgtatcaggaaaatataataaatttttgaaaaatgtaatgggatatattgtatttataatacagtaatcactatgtaaccaacatttttatttccatcaaaaattagttataaagaaatagaaatctaagaagtttaatagatattaccattgaacactagatttgtattagtatcttttatatttatctctctcatttcctatattggccatgtttacttttaaaatagtaaaagtcataagctctattttaaaaataaatgttagtttattaacccaagaataatagctaactataaattcatatttgataaaataaaaagatgacattcatcataagggatacatacctgtgctagcatatggcatttttaaaatcacatgagtaatttgtaatcatcatagaaatattagaaaatacaaataagcaaacacatactgaaaatttagtgttcccaaatctaaaacagagacactgtttttttcttttgggattgtattttagatatgttcttaagttataataaagtaaatacttaaaaggcaaattgatacattaaggatttcaaagagtaaaactttttgttaagctttgatgttctttagaaagtttagattattccacaagtcactgtcgttgaaagaaaagtagttacagtggggtcttatgggataaggcattaccatttgttcagttgagagacagctatcactatgttttaagcattgttcatatattagctcatttaatcctcatagcaaccttatatgataggtacctttattagccccattctgcttaggaagcaacagaaagagtatgtattttgcctaaggttgcacaataagttaagctggggttccaattctagcaagttggttctagagtgtatgttattaaccattatgccgtagtgcctgcaagtagatctctagatgtcagaaatactcatcttcctctggttacctggttgttataaatctttatgcttaatacttatgtcattatatgtaaatttcgtattaaacactcaacttattcagaagaatatcaggtaagtgtaggttaaggctgttttctatcagaaatcattatatgtatatatattcctcagttcttatgttgtttagtttttctaaaatgtcaaattttataatatatggagaagtataaatgtatattagaaagattttgtttatttgtgtaatttgtggcataagaaatatttgcctcaagatttggtgcttgtttaggtagttgctggcattacttttggaaatgtcagtaaattttcatactgtcttggaattttttcaatttttacattttattagtaaatgtaattacaggttagtaaatcacttatttgaacctgtttcctttgaaagttttatatttttatttggaaatagaaaaaccttaatttcctctcgttgggcagtatggtgtcaaaagcttgggctttggagcttcgtatataatctgggttcaaattataacttactagttactaacttgggcaaattacccagtctttttgactctcaatttctttgtctatgaaatgtaatactatttaggattgttaggattaaatgagaatatatttggcatactgtctggtacatgatacttaacaggtactagttgtctacatctttctaacttaggatggatgccgatgtcttgggtaacatctcaaactttatcagtaaggaaggtgagaatctgaagaaaatgaaaccttaaaaagattgaattcctggactccatttaaaggagtaaatagctcacgaacaagacttgctgctctgcaaagtcttccatgttgatcctggtctttgactccttatctgtctgattaaattgaattcgctgccgtggcatccttaaagctggaccttactttgtcagtcctgccttctccatgttgctttgtgtgtaagcttcactggactgtttgctttttgctgattattttatgtatttccatatgtctactttagcctttgcttggaatgttctaactgctcttgtttcttcctctgtttactggtttctgacttaactcttaaggattatctaatatattacctacttggtgaaggtttatctgtgtccccacagaattaatccttccctctttaactcttaagctatcttattttttatctaatcgggtctttggcacaattataggtctgtgtgtctgtcttccctaatagaataggaaagccttgaggacagtagtctttgcttacttagccttatattctcagtgccccttgtgcaaaacgttcaatatatgtttgaatgattatgtgaatgaaggagggggccagctgaatttactttaatgattatgtaacacccatttatgtatagttatagacttgtctgaaatgagttaaatcctttgcaacgtttgctgctatgctttgaatgtctcttacaaaactcatgttgaaatttaattgccattgtaatggtattaagagatggaacctttaagaggtgattagataatggtatctctatccttatgaatggattaatgctgtttgaatggtagtggatgagttatcttgggagtttggcctcctccgtctcacatgcttccttaccttctgccatgtggtaactcaacacaaagatccttgccagatgctgatgccatgctcttggacttcccagtctccagaaccgtgagccaaatacatttctgttcattctaaactacctgttttgtggtattctagtaaagcaacataaaatttactaagaaaactggtaccaagagtgtgattgttgccataacaaatacctgaaaatgttcaaatggcttgggttctggctagagaaggatggaagagtttggatgaacaggctagaaaaagcctgtattgctgagaatagagcattaaggacaattctgatgaggattcagaagaagagagctgtagggaaaatctggaacttcttagagagttgtcatcagttggtagaactataagtggtaaaggtctttctgatgatatctcagaaatgaagaacaagatactggacactggagtaaaggccatccttgttaaatagttgcaaagaacttggcgaaattatgttcatatcctaagactttatggaatgcagaatttaagagtgatgaactaggatatgctgcagaagaaataactcagcagcagagcatttaggttactggatggctacttttaaccacttaaactaagctgggggaagggaatgacttgaagacagaatttataattaaaagagaggcagaatggaaatacttggaaaatttgcagcctggccatagtaaagaatgcaaaaggtatgtttaggagagcaaaccaagggtgtggtccaggaaccatttgctgaagagattaatattcctagaggagacccaagggctatttatcaagacagtggaaaaagaccccagaggcattttggagatctttgaggctgcctgccccatcacaggcccagagctctaggagggcagaatggtttgtggctcaggtggtccttcacaagcttgctgcccagggctacctcagctccccatatttcaacccagtgggccttggctgtcctaggtctggttcagaggggcccaggtgtggcttaggctactgctgagtactcaaatggtaaaccttggcagcgtctatatggtgctaattctgcaggctcacaggatgaaagagctgtgggagacatggctaccaccaccaggatttcaaaggatgatggggatagtctgggagagacttgccacaggcttggagcctctgaagggtggaaatgtgggttggagtcactacagagagtccctactagggcattgcataatggagccatggcagcaggcccaccaccaaagcttcagaactgtagagctacaagtatacagtgccagcctgggagaacttcaggcttgagaccctaacctgtgaaagctgcatgggctaagtacagcaaagccatggaggtggggcttcccagggtctattgggatgaaacgaatgtattttgtaggtgagaaggacatgagttttgaggcccaggggcagaatgctatggtttggttgtttccttcaaaactcatgttgaaacttcattgccatgtggcattattatgaggtggaacctttcagaagtggttacattataagggctttgccttcattaatggattaatgccattattgcaggtgtgggttagttatctctggagtttggccccctttttctctatcatgtgctcatgccctcttttgccatgtgatgccttctaccatgttatgatgcatccagaagactctcaccacatgcagccccttgatcttagacttctcagcttctagaactgtgagtgaaataaacttcttttctttataaattaccccgtctgtggtattgtatagcagcagaaaatagacatcagcctgaagttcccccaggctggcattaaatactaattattaattagtatttatagtgcaaggataaattcaagtttagccctggttagaatgaccacatttcaagggaggggctttgtacttctgtgcatatctgtaaggataaaaatcttaatactattctcactgaaattaatggtttaggttaggtaaggttgttagtgctaataattatttcttttaataaaatattcttagttgcgttgttcaaaaaacatagatgatttgaatttatattttttggccaaaatatatttataattttgagtaggaattccagagtattggtagctataaccactttgggttccctgccattgcttctggtgcctcattttttctgacgtcttccattttcttacatttgtcttctaaggtggagttaagattactcagttaagattatttcactttaggcctctgctgtcttctgcttttttttttaaaatgaatggatataatatcccaatacattttgataattgaacaacagctacatttttaagtgaggctactttcttctaattttttaaatttatttttctcagtttttaaaaaaaatgtcagattggctaagagttggggcagctttcttatgtgagagtagtagatgacagcaaatatttgtgatgttaaaatgataatcctaatagttttcttttagaatctttataataaaaaccctttgaggctgagggtgaatttgtatgttcctaaagtgacaaaaaatgttcttggggcatagtaatttaaatcttagatgcttttattagtataattttttggtagaaatttggcattaaaaaatgcatacagagctttttctacatacagggcaagacagcattttgtcatggcaattagtaaatagataattataaaacatctaattttaagcaatttgttacagaaacgatacaggtacattgtggcaaaaatagaagatacaaaacaagcaaatatgagaaaaaatatacatgccaccacctatatatgacttttagtactttataatcttttgtctatatatgtctatatggatatatacgtattctttttatccaaatggtattacattgtacattctgttttgaaacctgccttttttagtcatttacatctacttttccatctcagtaacttttcatcttgtgtaatgcccggatcacattaaaatgtttccaattagctcaaaaatgtcctttatggctggtttggctaaaacagtatccaggccagcattgcacctatgaaattggctgttaggaatcttgtatctttaaaaatcaagggcagcaacccatcctcccgcttcccccacctcccaccacccccccaccttttttttttcttaaagatactggcttgttgaagagagaatgggtcatgtcctacaaactgtctgaatttgtccagtttgctgtctcatagtgtcatttagcttgttttatcctatgtatttcctgcaaattaaaatttgtatctgaatccttggtggatttgagttgaagatccttaaccatcatagatgatgctgtgtcctttatattgcatgtcagaagttacatgatctttacttgattcatgatgaggagatggccactgaaattggacagtgacagtcttttctgcccattgttcaattatattcgtctctttacattagaaagtattttgggtagtagtattttggtgctgtaagaaagttcattttctcatcaaccactcacctattggtttaacaccatttgttgatctttgagtatatcagtaatttcatcagggtttgcaaaataagactttaaattctattgttttacattattaattgatgttttttgataaggtagaacttgtgaaatgggactatttgtttgtctttaaatacagtctctataggaaagacaaaataaatacttaaatctcactctttaccatttttcaaagtgaagaactattccgttaaccacctcaaaagatgataaataaaaagggtatttttagttgtttcaactttttttttttttttgagatggggtcttactctgttgcccaggctggtgtgctgtggtgcaatcatggtacaccgaagcctcagtctccctgggctcagatgattctcccacctcagcctgggactaaaggtgtacaccaccatggccagccaatttttttgtattttttgtagagatggggttttgccatattgcccagcctagcctcaaactcctgggctgaaggaatccacccatctcagcctcccaaagtgctaggattacagacgtgaccaacaatatccggccttaacttttttcttttgagtgtctttatagactcaaggacttttatttaattcagggtgttagtaccatttaaatgttttctttgatgctcagattatcacagctagtcatttggacctttataccacctcctatgtccatttgatataggccattaatctctataagccttcctccttctcttggaatgaaaaggtatcctaggctcacctgtaccttccctactccagacctggcattaagtctttttccaaggagtttggtaccttttagtttattatgatattagagatgaaaatctgtgttctaggaatgtttattactgctagagtgatgttgcttttaggccatttcagagaaaagacctagaaaacagatttttacaaacatgaattcatactgatatttttagttttttacatgatttcttgattttacaatattatctgctttcttaacttaaaattatgaaccttaaagtcattagcataacttctttgcttatttctacaacataaagaaaatagtcctggtgcggtggctcacactgtaatcccagcactttgggagattgaggcaggtggattgcttgagctcaggagttcaagaccaacctgggcaacatgatgaaaccttgtctttacaaaaaattagctgggcatggtggcatgtgcttgtattcccagctactcaggaggctgaggtgggaggatcacctgagcccaggaggtcaaggctctagtgagccatgatcatgccaccacactccagcctgggtgacaaagtgagaccctgtttcagggggaaaaaaaagataaaatagtttgaggaggctggatgtagtggctcatgcatgtcatcctggcactttgggaggtcaaggtgggaggatggcttgagcccaggagtttgagaccagcctgtgccacatcatgagacctggtctctatttaaaaaaaaaaaaaaaagaaaatagtttgaggatatcaataatgatattactagaatcagtaaaactaccaaaagaagtttaaagtttcttcctagtgtttttttgttcttagaatacttcctaccaagaagtgcagtaaaagtgcagtgtccaaatagcccttgtaacaaaacctttctctttctcctgggtgccaatttgacatttaatcagttttgtttctagcagtgttcaatttattagattataagtcttttttttctttatattattctaagatcaaaaatatataaagatatacacaggagtcctgctgctacctgttcttgctatgcttttccccttttcttccctttctctgtgaagcagccatttttattagtttcttgtttatcactcatgcatgcatatgtttattgaggatgttgacattcaagcaaatatatgggttaacattctttttgtcatccctatacgaaagatatacccagtatactctattgggtgggtttttttccttaaaatattcagtagatctctccagttagcacatagttatcttatagatagaacatatacatataaccttttcttaaactatgctattaaaataatagctttcagtaacttgataattatttttggattgaaaatactactgaaatcaactcaatcatgtgaaagctgcagaaagaaaaagacctagaaaaagggcattggattaggtcaactttgaattttatttggaagataaatgagtccagaagtgagtgggcagagattattggagttggtcttgaaatgaggcgttaggcagattgactgggctggtgtgaaaggtctgtcagaaaatcatgagattagattgaggtacctcaaaaaatgagagctggtatgatgagtgggtaagaatcataaaagcgtagagtgttgatgatttttatagtttataaatggttcttgtgtgtagagttttgtttttatgctagctatagtctgtaacataattcactataatgggcatgctaaatatccatgacagttgacccttgaacaacacagagggtaggggcgcctacccctgtgcagttgaaaattcacatgtaacttttgactccccaaaacttaatatttagcctatacttgactagaagtcttactgatgacataatgttcgttaatacatattttatatatgtgtcagatagcatatttgtataataaagtaagctgcaggaaaaatattaaaatcataaagaagagaaaatatacttactattcattaagtggaagtggatcctcataaaggtcttcatcctcactgccttcactttgagtaggccgaggagtaggagagagaggaaaggtcagacttgctgtctcatgggtggcagaggtagaagaaggtccacatacaagtggtccgacacagctcaaaccggttttgttcattggccaactgtagtttgattgaaagtaataataaatgaagtttctgcctcagttcagtattatcaagtcatagatagcaagggctggaagaaaccttagtagtaatctctttgagtctaattatcatgtagaataggaaattgcggtctagaaaggttaagtgacttgtccaaattacacaactagttagagacatagccagctcttaaatctgacttccagattttcactgtgtcttcttttttctgtaacgtgttgccttttttagccatgaaaaattagaagttgaactcttgtcttttcaggcaggtgtcaattttggggttttgttttgatttttggtttttgacataaagtactttagttctgtgatgtataaaccgtgagtttctgtttttctcatatacctgaatactgtccatgtggaagttaccttttatctttaccagtattaacacataaatggttatacataaatacattgaccaccttttattactccagctatagtggggaaaactttcttttcataactagctaatgttttaaaaagtattcttttagtttgattgctgcatatttcagatatttctttccttaactaaagtactcagatatttatccaaacattattgctatgggatttcctgcagaaagacttgaaggcgtatacaggaacaatattgatgatgtagtaaggtaagaatgctttgattttctatttcaaatattgatgtttatattcatgttgtgttttcatttagaaaagatttctaagccacagaaaaagatactttgtgatgtaaactattattgtagtgctctataatcattttttggcttaccgtacctaatggacttcagggggatacagttcatttgataagaactgaccttatacattacataatcaggtacttatgtgatatcatttcctggactccataaaatgctggtcaccaggtttaatacctggattccattacagtgtgatttttgtcttatttcatagttggggattaggcttaaaatcctagagtggatttattcagttaaatttattcacactaagatgtagatgactaatactgtatatttttatgtagaccaaattttaaggtaccactgtgcatatgtataccaactacctgaagaagtatttggttggtacaagagatatagaaaggaatcgctgggtgtaccaaggctaatcagttttataattttgcataattttctaactgcgattatcatttagtttagaacaatttatttctcaaggcccatgtaaatattatttttaaaatatacagtcttaagaattcatggcatattttatgaaaggaggaattcatgtctgatgtgcaaatagtcttaacatattttctaatttcagagcaaaaatatatatgtatgaataaattaactgtaaattgtcagtaggaaccttaagaattcgtggcgtattttatgaaaggaattcatgtctgatgtgcaaatagtcttaacatatttgctaatttcagagcaaaaatatatgtgtattaataaatcaactgtaaattgtcagtaagaaccttaatggctttaaaagttaaaatttcaggtcaagcattgtggtgtgctcctgtagtcccagctacttgggaggctgaggtgggaggatcacttggcttgaacccccaggtagagggtagaggccagtctgggtaacacagcgagaacccatctcttaaaaaaaaagtttaagttgtggattatttcctttacactctttcattagtatctttcctggagactttcaatttaaatacttggtgcttatgacaattagatgttaaaatggatgggaaagtactttgtaacttataaagcattatgcagatgtagactccttttataatagttgtgtaagtatataagacaacctacattcttcatgagctagccataagttttagcaacttgctttgaaccacggtagatttacaattttctgtagtattgagttgtgttcatttagaattttgtaatatttatattgaaaatcaaatttttgtacctacaaaaactacaaaaaatccccctagtttttatagtttctattaaaattatagctggtacatagggatgccagaaggactgtttaagaagctgaaaatagagaaatgaatttatcttctcatagttaggcagggcacagtagaaggatgcttaacattgcaagctgatgggaacagcaggttgatatagcttgtgataacacttctaaagaaaaagcaatgagccatagaaaaaagaaaaagatacattttgaattaaggaagatggtgaatctgggaagtgagcagtacagtcaccagacgtgtatcctctcctatggtacagaagtgtttattgggtctctttatggcctgcatgatatatcccacaagatgacctacttcacattattttaattctgtattcaactaagcactaattcaacccagccagattagtactcataccaaaaaagagtgaatactctgaatagagggcaggttttctgattatggtgagaatatctttgtggtaaattaatctggtgtgctagtttttacgttggtctcttctcagtgtcgttagtcactgaggctgattgatcatcttttaggttactgataaagttcctgtacagctgattttcagaccttagattgcaataacttcaccaagaaaatacttcattgggaagcattttggtccttccatttgattcataactcttacctttatgcctctgaaggaaaagatttatacattcagcttgtaattagtaatcaagactgaggtttagtctatctagcttcacaatctatctagtttgttttgtctagccatatgatttcttcaaatatgccatttcttaaaaaaaaatgttttatgtatcccgattaatatttagccagtggttcttttagccgatggatcttgtcacctcttatgatactattaatagcatgtcaacatgaagaattatctgctgaatataatagctatgctgtccttgtttccttttgtctcattcttttttgattgggggataattggccaataaagctttgatagcctctattgcccaggcccctcctcttcttttatgagagaaaggatgaacagtgaccagaaataaaggtattgtttttttctatcaactaaaatggaaataaataattcctaagtaatttgcctgttaggattaaagtctccaagagaatggctgtgcctagtacctaagtgattaatttccttgattggttcacattatattgaggatattagtaatcagtagtgattccttttttggttcaaagatgatagtgtcacagtgaaaaatgtttttaaaatttttgtatacttaatttttctgttaacgaaagtattttcagttggatttttgtttgccctctctattagaatgcccaaagaatatttaaaattttccttttctcttatactgcatatttttcctgtgatttttccccaaacggaaaatactctgcagagattagactttgttattgttgtactacatcattgctttgactaaaataaactcagattgcaaataccttcaagcttacattgctcagtatttttttttttttttttttttgagacggagtctcactcttgtcgcccaggctggagtgcagtggtgccatctcagctcactgcaacctctgcctcctgggttcaagcgattctcctgcctcagcctgcggagcagctgggattatagatgcccgcccccacgcccagctgatttttgtatttgtagtagagatggggttttaccttgttggccagtctggtctcaaactcctgacctcgggtgatccatctgtctcggcctctggaattacaggtgtgagccgccacgcctggctaaattgatcagtattatttaactttgagggatatgatttgttatggaatgcgaagttttatacttgaggtactcagagtccttttgagacaaatatttaacttctccttttgaggttaccgcctacgattgggaattaatgtaaaaaataagccaaaagaaagtgagggaaaagtgaaccaagctgtaatttttttactcttttttattgttgttgttattgttgctgttttttactatcttgattgcaacagtttggcttatatatatagcatttggaattgacagtaagaaagccacatctcatagaagctaactattcccaaattgtttttttcttcttttcctcttactactgctgttttcctcctttcttgctgctaagctcttgtcctgacatgctggtaatatgaaacagtgttttattcagataattgattattctgtaatatgtatgttaatcttttttattacactttaagtaatagggtacatatgcacaacttacagattcgttacatatgtatacatgtgccgtgttggtttgctgcacccattaactcgtcatttacattaggtatttctcctaatgttatccctctcccaaccccccaccccaggacaggccccggtgtgtgatgttccccgccctgtgtccaagtgttctcgttgttcagttgccacctgtgagtgagaacatgcggtgtttggttttctgtccttgcgatagtttgctcagaatgatggtttccagcttcatctatgtccctacaaaggacgtgaagctcatccttttttatggctgcatactactccgtggtgtatatgtgccacattttcttaatccagtcagtcattgatggacatttgggttggttctaattctttgctattgtgaatagtgctgcagtaaacatacgtatgcatgtgtctttatagtagcatgatttataatcctttggatatatacccagtaatggaattgctgggtcaaatggtatttctagttctagatccctgaggaattgccacactgtcttccacaatggttgaactagtttacagtcccaccaacagtgtaaaaatgttcctgttcctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtctataaatgtcttcttttggaaagtgtctgttcatatcctttgcccactttttgatggggttgtttgatttttttcctgtaaatttgtttaagttctttgtagattctggatattagccatttgtcagatgggtagattgcagaaattttcttccattctataggttgcctgtccactctgatggtagtttcttttgctgtgcagaagctctttagtttaattagatcccatttgactattttggcttttgttgccattgcttttggtgttttagtcatgaagtccttgcccatgcctatgtcctgaatggtattgcctaggtttgcttctagggtttttatggttttaggtctacatttaagtctttaacatttaagtctttaatccatcttgaattaatttttgtataaggtgtaaggaaatgatccaatttcagctttctacatatgactagccagttttcccagcaccatttattaactagggaaccctttccccatttcctgtttttgtcaggtttgtcaaagatcagatggttgtagatgtgtcatgttatttctgagggctctgttctgttccattggtctatatctctgttttggtaccagtaccatgctgttttggttactgtagccttgtagtatagtttgaagtcaggtagtgtgatgcctccagcttttttctttctgcttaggattgtcttggcagtgcgggctcttttttggctccatatgaactttaaagtagttttttccaattctgtgaagaaatttattggtagcttgatggggatggcattgtttctataaattaccttgggcagtgtggccattttcacgatattgattcttcctacccatgagcatggaatgttcttccatttgtttgtgtcatcttttatttcgttgagcagtggtttgtagttcttgaacaggtccttcacatcccttgtaagttggattcctaggtattttattctctttgtagcagttgtgagtgggagttcactcatgatttggctctctgtctgtctgttattggtgtataagaatgcttgtgatttttgcacattgattttgtatcctgagactttgctgaagttgcttatcagctgaaggagattttgggctgagacagtggggctttctaaatatacaatcatgtcatctgcaaacagggacaatttgacttcctcttttcctaattgaataccctttatttctttctcttgcctgattgccctggccagaacttccaacactgtgttgaataggagtggtgagagagggcgtccctgtcttgtgccagttttcaaagggaatgcttccagtttttgcccattcagtatgatactggctgtgggtttgtcataaatagctcttattattttgagatacgttccatcaatacctaatttattgagagtttttagcatgaagggctgttgaattttgtcaaaggccttttctgcatctattgagataatcatgtggttttttgtctttggttctctttatgtgatggattatgtttattgatttgcgtatgttgaaccagccttgcatcacagggatgaagccaacttgatcttggtggataagctttttgatgtgctgctggattcggtttgccaatattttattgaggatttttgcattgatgttcatcaggggtgttggtctaaaattctctttttttgttgtgtctctgccaggctttggtatcgggatggtgctggcctcctaaaatgagttagggaggattccctctttttctatgaattggaatagtttcagaaggaatggtaccagctcgtctttttacctctggtagaattcggctgtgaatctgtctggtcctggacttttttcggttggtaggctattaattattgcctcaatttcagagcctgttactggtctattcagggattcaacttcttcctggtttagtcttgggagggtgtatatgtccaggaatttatccatttcttctagattttctagtttatttgcatagaggtgtttatagtattctctgatggtagtttgtatttctgtgggatcagtggtgatatcccctttatcattttttattgcatctatttgattcttctctcttttcttccttattagtcttgctagcagtctatcaattttgttttttaaaaaaaccagctcctggattcattgattttttttttgaagggttttttgtgtcctatctccttcaattctgctctgatcttagttatttcttgccttctgctagcttttgaatttgtttgctcttgcatctctagttgttttaattgtgatattagggtgttgattttagatctttcctgctttctcttgtgggcatttagtgctataaatttccctgtatacactgctttaaatgtgtcccagagattctggtacgttgtgtctttgttctcattggtttcaaagaacatctttatttctgccttcattttgttatttacccagtagtcattcaggagcaggttgatcagtttccatgtagttgtgcagttttgagtgagtttcttaatcctgagttctaatttgattttactgtggtctgagagacagtttgttgtgatttttattcttttacatttgctgaggagtgagtgctttacttccaactatgtggtcaattttggaataagtgtgatgtggtgctgataagaatgtatattctgttgatttgggatggagagttctgtagatgtctattaggtctgcttggtgcagagctgagttcaaatcctggatatccttgttaaccttctgtctcgttgatctgtctcatattgacagtggggtgttaaaatctcccgatattaactgtgtgggagtctaagtctctttgtaggtcactcaggacttgctttatgaatctaggtgctcctgtattgggtgtatatatatttaggatagttagctcttcttgttgaattgatccctttaccattatgtaatgcccttctttgtctcttttgatctttgttggtttacagtttgttttattagagactaggattgcaacccctgctttttcttgctttccatttgcttggtagatcttcctccatccctttattttgagcctgtgtgtgtgtctgcatgtgagatacatctcctgaatacagcacactgatgggtcttgactctttatccaatttgccagtctttgtcttttaattggggcatttaccccatttacatttaaggttaatattgttatgtgtgaatttgatcctgtcattgtgatgttagctggttattttgcccattagttgatgtagtttcttcctagcatcaatggtctttacaatttggcatgtttttgcagtggctgataccagttgttcctttccatgtttagtgcttccttcaggagctcttgtaaggcaggcctggtagtgacaaaatctctcagcatttgcttgtctgtaaaggtttttatttctccttcccttatgaagcttagtttggctggatatgaaattctgggttgaaaattcttttctttaagaatgtagactattggcccccactctcttctggcttgtagagtttcagcggagagatctgctgttagtctgatgggcttccctttgtgggtaacccgacctttctctctggctgccctttacattttttcctgcatttccaccttggtgaatctaacaattatgtgtcttggggttgctcttctctaggagtatctttgtggtggtctctgtattccctgaatttgaatgttggcgtgccttgctatgttggggaagttctcctggataatatcctgaagagtgttttccagcttggttccattctccccgtcactgtcaagtacaccaatcaaacgtagatttggtcttttcacatagtcccatatttcttggaggctttgttcatttctttttactgttttttctctaaacttctcttcttgcttcatttcattcatttgatctgcaattactgataccctttcttccacttgatcgaatcggctgctgaagcttgtgcatgcgtcatgtagttctcgagccatgattttcagctccatcaggtcatttatggtcttctgtacactgtttattctagttagccatttgtctaatcttttttcaagatttttagcttccttgcgatgggtttgaacatcctcctttagctcggagaagtttgttactactgaccttctgaagcctacttctgtcaactcgtcaaagtcattcttcatccagctttgttccattgctggtgaggagctgtgatcctttggaggagaagaggcactctgggttttagaattttcagcttttctgctctgttttctccccatctttgtggttttatctacctttggtctttgattatggtgacctacagatggggttttggtgtggatgtcctttttgttaatgttgatgctattcctttctgtttgttagttttccttctaacagtcaggtccctcagctgtaggtctgttggagtttgctggaggtccactccagacactgtctggatatcaccagtggaggctgcagaacagcaaatattgcagaacagcaaatattgctgccggagccttcctctggaagcttcgtcttgggggcacccggctgtatgaggtgtcagtcggcccctactgggaggtgtctcccagttaggctacaagggggtcagggacccacttgaggaggcagtctgtccgttctcagagctcaaacactgtgctggtagaactactgctctcttcagagctgtcagagagggatgtttaagtctgaggaagtttctgctgccttttgttcagctatgccctgcctccagaggtggagtctacagaggcaggcaggcctccttgagctgtggtgggctccacccagttggagcttcccaaccactttacctactcaagcctcagcaatgatggacgcccctcccccagccaggctgctgccttgaagttcaatttggaactgctacgctagcagtgagcaaggctctgtgggcgtaggacctgctgagccaggcacgggatataatctcctgttgtgccatttgctaagaccgttggaaaagcgcagtatttgggtggcagtgtcccaattttcccggtatagtgtgtcacagcttcccttggcttggaaagggacatcccccgaccccttgtgcttcctgggtgaggcaatgccccgccctgcttcagctcaccctccgtgggctgcacccactttccaaccagtcccagtgagaagaaccaggtacctcagttggaaatgcagaaatcacctgtcttccgcgtggatcatgctgggagctgcagacaggagctgttcctatttgaccatcttggaatgccacctttttttttttttttttttttttaaggcagtttcttgctctgtcacccaggctggggtgcagaggcatgatcacggctcactgcaacctctgccttctgggctcaagtgatcctcccacctcagcctcccaagttgctgggaccacagccacgcatcaccaggcctggctaatttttgtgttttttgtagagatagggtttcgctgtgtttcccaggctggtctcaaactcctgcgctcaagcgatccgcctgcctcagcctcccaaagtgctgggattacaggcatgagccactgcacccggccaatatgtatgttaatctcatccctcaagctgatactgaagtttttcaatttatgttatttggtgtaaatctaggcagtctttaacaaaattggtgcttcatgtgtttaagaggcataacttaagaattgtttgtttcttataaatcaggagaatggaggtttaatagaggtgaactgtctttctcactgcagaacctttaatatgccactatgcattgtaaatctcccaagagtgagattctagtatgatgcttttcttttccttttctgttctttccctttccctctacctcctttttcttttctttgttggtggcatgagtcctatattataaggaaatgcttttagagtacagtcttctgatatatagtgatttttgaaaaagatttatttattgtcttgttcactgtgagctttttcccccatgtataagcagctgtgtaatagattcaagagcaccccctcgcccctttttttttgagacagagtctcgctcggtcactcaggctggagtacggtggtgctgtgatcatggttcacctcgacttctgggctccagcgatcctcccacctcatcctctcaagtagctgggaccacaggcgtgtgtcaccgtacatggctaatttttctatttttagtagaggcagagtttcgccatgttttccaggctggtctcgaactcctgaactcaagcagtccacctgtctcagcctcccaaagtgctgggattacaggcgtgagcctccactcccagtctcaaatattcttttgaaatatttgaaatatgttgatctctcagtctttcaaccttagttgtatgttgattttcaataaaaaggaagtatttgttgccctaacatcagtattggctattcagtttaaaaaaggagttaaagagatgttatttataggcaggcttcaaaagaggaaagaatgatcagtttcattctctgtttctagcatattctgactccttctctcatattacctcgtttttcccacattttttctttaataaagtgaaattcacataacagctaaccattttaaccacggaaagtgtacattccgtggcatttattaccttcacagtgttacctctacctttatcaagtttcaaaacattttatcaccccaaaagaaagccctgttcttattgggtgcctcttgcttttttttttttttttttttttaaatcttgagacggggtcttggtttgtttcccaggttgtagtgcaatggggcgatctcatctcattgcaacctctgcctcccgagttcaagcaattctcctgcctcagcctcccgtagctgggactacaggcacgcgccacatgcctggctaatttttgtatttttagtagaaacgtggtttcaccatgttggccaggctagccttgaactcctgaccttaggtaatctgcctgccttggcctcccaaagtgctgggattataggcgtgagccaccgttctggccacctcctacttctttcattagtcttaattccttagtggatttgacagtgtttatattatctacaccaatgcatttttttgtatgttaataataggagatatttattgggcatttatttacatacttatttgcatgtgtaactgttgtatagccagtttatgtatataatcttactaaatctctacagtaaatctatccccatttcatagatggtttaaaagaagttaacttccccaagcattacttttagtaagtagtgagactgaaggttgagttctggtctgtcagattccgaagttgtttccttaggaaccatattatcttgtgtacaactcttgggctaatcttgttaatattctttatttgacctcacactgttgattcataccatgtttaaaattgaaatacattacctatatttaaaaattgagacctcacataaaaagctatatttctagctgcttttgaaatttcgaaggatcttccaacacttggctgacattcctgcgtgacaaaaatcagctggagctgtgtaatgtccgacctgtctctgtcaatgaacagattattcattgtcatttctcatctgtttttgagattgtaactttgattctgtataactcatagaattagtagttagacctatatatgttagttattacattatttgtatatgtacagactgctttagacaatattgtagtgttatatgttaattttatcaattaaaatgtgctataggatcattgtagagatcttgtctctaattaacaggattcataaagagaaaacaaaggagagaaacatccagattgaaaagacctacatagtgccaagcacaataaaagaaaccctatactaggcaaattattatgaaatttgttttaggacaccagaaataaagataatatctaaaaactttttagaatcgcctaggagggattaggaatatgaatagcatctaacttgttggcagtagaattgaaggtagaaggtggtaaaacatcaccttgaaagttctgcattcagcctagaattctgtatccagttaaaccatcaatcaagtgtgaaagtagggggaaaaactcaaggactaaaaaaatgtgctcatgaagaacattttttttggacattacccagaagatgtggttcaacaaaacaagggaataaaccaagaaaggaaataaaagagcttcagtaaacagagaatcccactcagaagcaacaaagaagaaagtcccaggatgacagctgtgacacaagctgaaaagttaccagttttgcttggagcaggagattagaacttccgggaaaataatcaaattgatagatggatgttgaaatatttggagaaaaatgtaatggattcttgcaaaactgagcaaattagaaaaaggaaacaattattagcattggtggtttgagttaacccaaaattgtgatgttgctattttaggggaattaagataagtgaaacacgtatggaatactgctagttttgtaagtctcctttaccatggcaggacatctgtagttaataaatctgtaagaagcagtattaagaataatattttaaaatacctaattaaataggaggaaaaagaatccgagtagttgagggtgattgcatctggggagaagcaggaataaaggtttgaagataaatagggccagagatgagtaattttgttactgtgataatatattttatatatatgtgtatgtgtgtgcgtgtgtatatatatatatgagatatatctcatatatatgagatatatatgatatatatatgatatatatgatatatatatataaaacatacagttcagtagcattaacatctagcattcagtacatttacattgttgtgcaattgtcaccactgtccatctctagaactttttcattatcccacactgacataccacacccattaaataataactcctcattgctcctcctgttagtaccaaccattgttctactttcatctctatgtatttgactattctaggtacctcgtataagcggaatcacgtgatatctttttgtaactggcttatttcactaactatcttcgaggttcatccatgttgtagcagttgttagcatttccttccttttaaaaggccgaataatattccattgttatgtatataccatattttgtttatccatttattcatcaatagacacttttggctgttgtgaataatgctgctatgaatatgggtatgtaatacctgtttgagtatctgctttcatttcttttggatatgtacccaaaagtgagattgctggattgaatggtaattctatatttaaatttttgagaaaccaccatactgtttgatatactggctgcccaattttacattaccaccagcaatacactagggttccgaatttgccacatcctcaccatcgtgttgttttgtttatgtttttttttaataatagccatcctaatgggtgtgaagtctcattgtggttttaatttgcattttcctaatgatcagcgatattgaacatttgcacatgcttatttggtcatttgtatatcagctttggagcaatgatgtctcttgaagccttttgcccatttatgaattgagtagtttgggatttttaaattgtgttttagaagttctttgtatactctggctgggcacggtggctcgtgcctttgggaggccgaggcaggtggatcacgaggttaggagttcaagaccagactggctggtatagtgaaaccccatctctactaaaaatacaaaaattagctggtgtggtcgggcgtgatggtgcacacctgtagtcccagctgttggggaggctgaggcaggagacttgcttgaacccggaaggtgggggggttgcagtgagctgagattgtgccactgcactcagcctgggtgacagagcgagactctgtctcaaaaaaaaagaaaaagaagttctttgtattctctgaatattaatcccttattggatatgttatttgcaaatattttctcccataaagaatgggttactttttcactctgttgattgtttcctttgctgtgcaggagctatttagcttgaaaaaatccaacttgtctgttttcttttgttgcctgtacctttggtgtcacattcaagaaataattgccaaattcataccatgaaactttcccccatgttttctcctgaaggtttttatagttttagctctcacatttaggtgtttgatccattttgagttaaattttgtatataatgttatgtaagagtccagcttcacacttttggatgtgaatatctagttttcccagcattatttgttgaaaagagtgtctttttccccattgaatagtcttggcactcttgttgaaaattatttgacaatagatgcaagggtttatttttgggctctctcgactattctgttagactatatgtttgtttttttatgtcaggaccaccctaattttagtactgtagctttatagtaaaatttgaaaccaggaagtatatgtcttgtgtatttatttacttattttttgaaatagcatctggctctgttgcccaggctggagtgcagtggcacaatcttagctcactgcaacctccacatctgaggttcaagcaatcctcccacctcagcctcctgagtagctgggattgtagacacataccaccatgctcagctagtttttgtatttcttgtagagacagggttttgccatattgcccaggtgggtctcgaactcctgagcccaagcagtctgccctcctcagtgtcccaaagtgttgcgattacaggtatgagccaccgtgcatggccccaacttcttatatttcaagatggttttggcccttcagggccctttgtgagttttaggatggattttttttttaacttttaagtttaggggtgcatgtgcaggtttattacataggtaaatttgtgtcaaggtgttctgttgtatagattatttcatcacccaggtattaagcctagtacccattagttatttttcctgagctcgcctcctcccacctggatttttttttttatttctaccagaaacattgttgggattttggtagggattgtattagtctgtagattgcattgaatagtactgacatcttaacaatattaagtctttaaagccatgaacaccagatgtctttccatttatttacgtattctttcttttctttcagcaatgttttgtaattttcagtgtacaagtattttacctccttggttaagttaattcctaagtattttattcattctgatgatcttataaatctgttttcttaatttcctttcctaattgttcattcttagggtatagaaacacaactgattcttcgcacattaaatttgtgccctgcttcttcgcgggtttgtttattctttttttgtgtttgaaatccttgaggttttctgcatataagattatatcatctgcaaatgagataattttacttgttcctttccaatttgagatgatttttattcattttcttaatgctctctcatacattcaatactatgttgaatggaagtggtgaaagcaggcatcctgtcttgtttctgaccttataggaaaagctttcaattctttgccattgactatcatgttagctatgggattttttttttccccccagatagagtctcgctgtgtcgcccaggctggagtgcagtggtgcgatctcggttcactgcaccctcctcctcccgccaggttcaagtgattctcctgcttcagcctcccaagtagctgggattacaggtgtccaccactatgcccagctaattttcgtatttttagtagaaacatggtttcaccatgttggccaagctggtctcgaactcttggcctcaagtgattcacctgcctcggcctcccatagtgctgggattatagtcagccaccatgcctggccactgtgggatttttatatatggccttcattatgttgtggtaatttctttttattcttagtttattgagtgtttttatcataaaatcttgttgaattttttcaaatattttttctgtgctagttgagatgaccatgtgatttgttttcttctttctattaacatgatatattgtttttcatatattgagccatttttgcatcccaggaataaattttacttggtcttcgtgtataatccatttaataagctgtggaattcagtttgttggttctgtgttgaggactttatatcaatgttcctaagggctactggtctatagttttcttttgtagtttctttgactttgctatcagggcaatgctggcctcattgaatgtgttaggaagtgtttcctcatccatttttggcaaaactttgggaaaaaacgatgttctttaaatgtttgatagaattcacagataaaaaaatcacatctagggcttttgtctggaatttttttattgttattattgattcagtcttgttactagttataggtctattcagattttctttttgtgtgtgtgattcagtattagtacattttgtacttctcgttatttctccatttaatctatattatctaatttgttggcatacaattgttcatagtactgtcttctcttttttttaaacttctgtgcagttgatactaatgtccctacttttatttcagattttagtaatttgaatcttctttatcttaatacaggtaaagctgggtcaattgttaaaattttttcaaagaaccagtttttggtttcattgatttttctctgttatttttctattatttatatcctctctaagctttgttatttccttcatcctgctagctttgggtttattagtttgttctttttctagttccttaagatttgaagttggattattgatttgagatcgttttcaattaaatgtgtacaactacaaatttccctcttaggactgcttttgctgttctgtaatttttggcatgttgtgtttttttgttttaatttatttctaagtattttctaagttcccttgtgatttcttctgcgtttaaccgtgtattttttaatttccacagttggtgaattttctactttttcttcagttattgattttattgattttcagtggcatcctgttgtgatagaagatactttatttggttccctgttttttttttaaaacagagtgttgctctgtcacccaggctggagtgcagtggtgcgatcttggctcactgcaacatccacctcctgggttcgagcaattctcctggtctcagcctccccagtaggtaggattacaggcacatgccaccatgcccagctaatttttgtatttttagtagagacagggtttcgccatgttggccaggatgatctcgaactcctgacttcaagtgatccacccgccttggcctcccgaagtgctaggattataggcgttagccaccttgtctggcccagatcctctattttcttgcctatattctgactgggtgtttttgtccattattgagagtagggtatcgaagtgtccagctgttatttcagaactgtctgtttaccttcaattctgtcaattttttgcttcatataattgggtggtctcttattaggcatgtaaatgtttttgattattatatcttcttgctatattgacacttattgatgtgtaatatcttttttgtctcaaccttgttttgatttagtttgtctaatattaatgtagctacctgcactctcatttggttattacttgtatagaatgtctttttacatcccttatttgtgtctttggatctgaaatgagtctcttgtagacagcatatacaatctcttgtagattgtgtttttcttatacattctgtcaaactctgccttttgattgaagagttttatcatttacaattaaagtaattattgataaggatttaactgctgccattttgctgtttattttctatatgccttacagcttttttgtccctcatttcctgccttactggcacttgtgtttagttgatattttgtggtgaagtgttttaatttccttgttatttccttttgtttatattctgctattttctgtgtgtgtgtgtgtgtggttgccattgggggtcacatttaatgccctaaagttataacactgcaatttcaatttataccaatttactttcaatagcatacaaaaattcagctcataagattcagtccctgctcccttccagttattgatgtcataaaattacatttttatgtattgtgtgtctaaaagcgtagactaataattgttttttaatgcagtagtgtcttaatttgtggaaaacaaaaagtggagttgtaaaccaatgttacaataatgctagctttggtaattgctcatgtatttatcatttctcagatctttatttcttaatacagcttcaagttactgtctagtctccttttatttcagcctgaaagactcacttcagcgtttcttgcaggacaggtctggtgataatgaactctctcagattttgttaatctggaaatgtcttaatgtcttcatttttaaggacatttttgctggatatagtattctcagttgacaggtatttgtgtttatttgtttgtttcctttcaggattttaaatatatcatcccactgccttctgtccttcaagagttctgatgagaaatctgctgatattgaggatccctttgtatgttacaagttgcttctctcattccatgttcaggattctcttttttcatagtttgattataatctatctcagtttttcctacttggatctctgagtttttcctacttggagttaattgagcttcttgaatatttatattcatgtctcatcaaatttgggaagtttttgattaatatttcttcacataatcttttttgccccttttctctctttttattctgggattcccagagtgtgtatgtgttggtccacttgatgatggtgttccacaggtgtcttaggctcttgtcttcaattttccttcagttttttttttctgttcctcagacacgtggtattttcagctgttctgccttccaagtttactgattcttctgcctgcccaaattggcttttgaattcctctagtaaatttttatttcagtttttgtacttttcagctccagcatttattttttgatttttttatgttttctctttattgatatttcaattttgttttttgacattatccatatcttcctttagctttttgagcacctttcaacatttgttttaaagtctatgtctagtaagtgtctgccatctgatcttctcaggcacagtttctgttaatttatttttttccttttggcctatacttaatgttttgcttggggtagtttttttttttggtatgctttgtgatttttgttgttgttgtcaaaaactggaatttgaatcttaaagagtggtaactttggaaattagatttttctcttttctctaagatgtgctattttgtttggtttttttatttgttgtagagtatttctatgctgggtgtaatcttaagatcttctcggcctgtgtttttccctgggcatgtgtagtgactttctaaattgccctatgtatgcagttcttttgcagtagtatcctccttaaatgtttggctcctaaaaggcaaaataaataaataaataaataaaaattaaaaattaaaaataaatcaaaggggtgaaatagctctggatctttaaatccctggagcaattttttcagccaatggcagttaaataatgatagtctgcctctgtgtcacattttgatcagaagcagcaattagcaatcagaacacagattcctgatatttggagggcaaggtctttgttgccaaccttgactcttacaaactgtgtgcagggtgctctgggaacatgtgcatggttgcctgctttgagagtgggtgatgggtagccgcgacggcacaaagagctgaaattgactcaaactaactgatttaccattcaagtctttccttagaaactgaaaacctgaatagactccagagttccagaatcacagattctgcttacagtcgtctaggtggggagatgggttcctggtacttctgattctgccatctttctttgactaattttttttttttgttcttgagatggagtcttactctgttgcccgcccaggctggagtacagtagcatgacctcggctcactgcaacctctgcctcccgggttcaggcaattctcctgcctcagcttcccaagtagctggaattacaggcgtgcaccaccatgcctggctaattttttgtatttttagtagagacagggtttcaccatgttggccaggctagtctcgaactcctgacctcaggtgatcaacccgcctcagcctcccaaagtgctaggattacaggtgtgagccactgcacccagctcttagacaaattttttattccaaactttttttattttatcatttgaaaggtatatgtttattattttgtcaaaaataattttaaaacgtattcttgaagcttatttagatctgtttcataggaactgtgaagaaagtaaagaatttaaaaaatgaagacagattttctcaccctgcttatgggtgcttctcgtgctagccttttgcaagtgtcgggaagtgtaacctgcaggaggcatcagggctttgggcctgcatggtctgagtgctgccctgtgagtttcagaaggcgcagcaacctgtatacctgaaagccatctctgctggggcaggtacctagtgtccccacctacctgggtcgtagtcaggccctgggcaagcctgctatgcttttccttccctaatccctcaggggtgggatagagagcacagtggcctcccagggaggtagaagctgctccagactaacaatcagagctgccagttcttaatccccaagaccgccagacttcacaaagacataccgaggtctgtgctgtcagtgccccactactacactcccttaagtagccccacattcttgtgcttgtttcttttttctgctctctttccttgcccaggtaagaggtctgcccataagggatattttgcagcatgtgaagctttttaaaaagttaggcttattgaagtataatttacacacaaagtacaaaaaaaaaaagactgtgttctcaaatctgtgagtcattaatgggtttagatgtttatatattgaaattattggaagtaaggtatgtttatattagaaagatttgtagtctagattatccaagttttgggagtattacctctctgcttttgtttatctacttttttagtctctactttccaagtatctataggcaaattttcccatttccctttggaaagtgctgttttcttgctttttttccgcctttccattgtgtcagacttataaggcaatcagccaactgtgggcatgaaatccttgggaggaaagagaaggaagtgggaggggcagccatggtgaatgtttccctaagttatagtcaagttctttgagagaacataacctcatcccctttttaaactgttgtaatactttcttttaaatagattgtttattctcctgcaagtctcacagttgttcacagtggtaggtaagaaatcataaagttcaaatattaaagggagctcacaaaagagcatggtttcaccagccctcactaaaaacaaaattatgggaaaatgctgtaaaagaaaccagaattcttggttgcaaatgatagaaagtgactctgatttacctaatcagaaaggaatttttaaaaaagtattaggtaggtcatagtttgacaacaagacttggaagataggtggaagctaagggaagcaagacatggccccaaggtttcaacaggagcaatctgcttaggactttgctgcttggacacttggtgtaatagctgctgccactatgcctcgaaactggtgactctgctcattaactcacctcctctggtgatctctaggaataatctctgactctcctgtaccttgtcctcactaggattcggtatccacggcaaaaagatctattaatagttggtatcaggcctgtacatgtgttaagagaaagatgaggaaagaagtatctgcttctaatctcttgaaattatctccaaattgaaatggtattttggttgcctaacagcctgaagatgacaaatatcccctacaaatttctcctattttaccctcttcctaactatatctgtaatttaaagtttcacatattcttttgaaaattgttttcattgtttacccactttttaagaaaagcaaatgggaacatactaccactgtttggcccctttcaaaaattttatatctgaggaatcttccatattgttgtggacatctacctacctgattcttttattaactaccttttatttcattttatgatcatgctatcattaataggcccctatgatgaatatataagttgtttccagttttttttttgtcattgagaacagttcacatatgtatcttgttgtcttttccaagtatatctttaaggcaaattcttagcagtggagttgctaggtccattgcgtctatggtttaaactagtgccttcaaaaatggtattttatatactcactgtttaagagtgcttcttccttctatccccactaactttggcaaactgaatagtttcaaactttaactttttatagcttgttggcaaaaaatggtatcttgttatttgatcgtgtttttttaattgtgaggtttagcgactttttgatgtattggtcttatgtactttctggtgtgtgtgtatgtatatactgaccctattttcaacttatttttcttttagtttgtttgtattttccttaatgattttcaggaaaccaattttattctttcttcagacagttgtctaatgttctgcttctcttgccatttgaattttgtgactacaaaattcagatgaaacaataatagcataaagaacttggtgggttatcttttgttttgcattattgattgtttattaagaaatattctttaaaagtcaccttgcttaaattagcaagtaggaaatgctttcaataaagagaactgtcatgtacccactactccttacttactgaatcatcttcttttggatagagaagataaaagtgaaaagggaatttaagagttcctgcctttttccttgtctttagcattatatagctgtttaatgtgtgggagtctaatttcttttttctttcttgagacaaagtctcactctgttgcccaggctggagtgcagtggcacagtcttggctcactgcaacctctgcctcccaggttcaagcaattctcctgccttagcctcctgagtagctgggactacaggcatgtgccaccatgcccggctaatttttgtatttttagtagatatgggacttcaccatgttggccaggctggtcttgaactcctgacctctagtgatctgcctgctttggcctcccaaagtgctgggattacaggcatgagccactgcacctggcctaatttttttattgttctttttggtgtgaacattctcccctcctccaagccttttgtttttactattttcatgttcctttatatgtgctgctgttttgtttcatctgtaattatctctcatccccttttttggctattataatatatatatgtacgttttgaatctgagctttgaaggtaaattcactgcagctgtgttggttgattttagataatttgtgtatttcctcctttgtcttttttaaactggagtcatttgtagttgtttatacagaattttagtttttaaaaccacaagtctttcattataggttgagttatgaattcatagcctgttatttaaatgaagcttttgaaatctgttttactgatctgtatcatatctaactacgccagtatttccttccttgtctgacgtgaactctaaaattatgtgaacactttctccctgtttcctggcatttccactcaaacttgttcctcattcttagttagaaatatatccagaattgtagtttctttctaatctaatgacagaagcaaattaatcaagcatggcaagaatttattggaaaactgcatgtagttgaaaatatgtttagtatatattttgacagctgtgaagtctctaatttttactgtaccttttctctgttccaattttatgctctattctaaggatgtacccatttctactacctgactagggagcatgtgtattgtatcccagcagattttttttttcatagatagatatcctttagatatctgttatccagtgtaggtagccactagccacatgtagctatcattatgtttaaatgtaaataaaataaaataaatttactgagttgtttttgctagctacatttcttgtgctcagtagctacatgtggcttgtgattactgtattaagacagcacagatacagaacattttcattattgcaaaagttctgttagacagtgctgttctatacagtgtcattctgcctctcattctaaaaagttctaattcctgaagttgatgtactctttctgttgctgtcctctagcttaatcaaaataaatttgagtctttttaaaggtaggttgcattttacatactgatatttctaaatcagaggctatttatattactttttttatattacttttaaaaattagctttattggagtataatttacatgcaataaaatctacccattttaaatgtacggttcattgacttttgagaaatacacacacacacacacacacacacacaccttcttgtaaacacacaccttcttgtaaacacaacaaccaagatttagaacactcgctttatgaaaagtttccctcatgcccatttgtagtcagtccccaaacctggtttcaggcaatctctgatctgctttctatatgctttgcctatactaggattacatataaatacagtcatatagcatgtattcctttttgtgtctggcttctttcttttagtataatatttttgaaatttatccctgttgttactagtatcaataatttgttcttttttattgctgactaatattacattgtatggatatgacatttctttattagtgtggtgggcatttgagttgttttcagtttgggtctgttatgaacaaagctgctgtaagcattcatgtgcaagacttttgtggacatatatttttgtttctgtttattcaatacctttgagtagaattgttgggtcacatgatgtagatcagttgaacagagtagattccagaaaagttcacatacacatttcttgacaaaggtgctgagattattcatgggaaaaggataatcttttaaacaaataatactggaacaatagagaaaacaaagtgaaccttgacttttatgtcttatcatatacaaaaattaatttgaagtggattgttgacctaaatgtaaaagtaaaatttaaaaatataaaacttctagatgaaaacataggagaaaatctctgtgacttttggtttaaagatttcttagacagtacatataaaattaactatataaggaaaaaatggacaaatttgactttatcaacattaaaaatttctgctcattgaaagactcaaaatgaaaaggcaagcagttttggagaaaatatttgcaatacatatatctgaaaaaggacttgaatgtataatatatacataaagatgctcttacaacttcataatgagaaaataaccccataaagagaagggcaggccgggtgcagtggctcatgcctataatgccagcacttttggaggctgaggtgggtgaattgcttgagcccaggagtttgagaccagcctgggcaacatggtgaaacccagtctctacaaaataaaaaaatacaagaaattagctgggcatgatggcatgcacctgtagtcctagctgtttgggaggctgaggtgggaggatagcttgagcctgggaggcggaggctgcagtgagctgtgatcgcaccgctgcacgcttgcctgagcaacacagtgagatcctgtctcaaaacaaacaaacaaaaaaaaaaacaaaaaatggaaacagaaattttacaaaagaagatatatagatggccagtaggcatatgaaaagatgtttaaaatcagtcatcagggaaatgaaaatttaaacgtaatgagatagctcatatttactggaatggctcaaaaagggcttacaggaattggcaaagacatagattaactggaactcttatgcatgttggttagagcacaaaatgatatgatttcttgggagaaatatttggcagtttttaagattatttttgatagccttctgaatttcttagtgagttataggtcagttctgccactgtttctttcttttctttctttctttctttccttccttcccttccttcccttccttgcctgtcttgcctgccttccttgccttgcctgccttgccttcctttcttcctttcttccctttcttttctttcttttctttttttttttaaaggagtctcgttttgttgcccaggctggagtgcagtggcacgatcttggctcactgcaacctccacctcccgggttcaagcaattctccctgcctcagcttccccaatagctgggattacaggcgcgttccaccatacttggctaatttttttaattttggcagaggcagggtttcactgtgttggccaggctagtctcgaacacctgacctcaagtgatctgcccgccttggcctcccagagtactgggattacaggtgtgagccactgcgcctggcctggcactgtttatttcttttccctccagttttatacctatttagagagattagattttcttgagtactaggaatcactatttttgagcagaattattcaaaactgttattattttttctttaacttgaggcaatgtaggagaaagcagtactgtgcaggtgaaagttacaaacaagaacattttaaacaagatagttactttccatgtattggatacgtaacagaattaattctaataaccatcctgaagatggtcaggaggcattagttaagaattgaaatgtttggagcttgcctgtgttgatgggattaaggcagggatgatttatgtgtaaatttatgcgttagtaacagcagtaaccgctgtagttacactagggttctaagagcaaatgttgattaaacatgaatgtagcaggagtgataaggtttggctctgtgtccccacccaaatctcatgtggagttgtgatcctcagtgttggaggaggggcttggtaggaggtgattggatcatgggagtggtttgtaatggttttagcactatcaccctagagctgtctcgcgaaagagttctcctgagatctgcttgtatataagtgtgtagcacctcccctctttgctctctctcttcctcctactcctgccgcggggacgtgcttgctttcccttggccttctgccatgattgtaagtttcctgaggcctctgattaaacctttcttcttctaaaagattacccagtctcaggtagttctttatagcagtgtgagaatggactaatacaaggggaaatatatatggttaccaaatagcgaattagccatgggaaaaagtagcaaataaataattattttactttttcagatgctaatttttcttttcgtttattttaggattggtgggagctgtccaatgtccttaggctgttttccaaatgagataccaaaagctagttctccatcgggtttctcaggctgctagaagcattcattattatggttgtcattacttcgagttctgttgccgctatgcccacagtagtatttgttacataacaggtgcttgataaatatttgctaaatgaatttttggaaaatacaatctgccacacctttcttctacagtttacaatcttctgttgagatcatccgatagattttttttcttagatattgtacttttgaggcctcaaattgctgtcttttgtattttctatgtctgcagagactttccatctttcactcattgtattcattgttttttaacatctttgtacatatttatagtaactgttttaaagtcactgtctgttaattcaaacatctggttcatcttggagtctgattctattgcctgctcttttttctttgtaataggtcatgtttttctgctttgcctgtctagtaaattttaatcgtatgttgaaatgtagggagtttggattgttacttcctttaagggtgctgagtttcattttgtcaggcatttaaattgatagttgatttagtattgtcaggtttggttctctttgttaaagcaggcatttttcagatttgtcttttgtcctagggcatggtttttaacttcaaggttgccctttccaatgtctcagctaagtatctggggtgttccatgaggtctcttccactttgcctaggccagaactccagcttctcccagtattatatttcgttacctctggcgtcatctccgttatgctttcagatcctgcgcatagacagcccagcccccagccaaggacctgagatgaaatccatacaaaattcttagtcccttgctccacaaactccaacagccttagcagtctaatctcttcctgtttacctcagtgaaatctgtgttccacttgagttccatttccttctgtatcagagaagagccaccatgctgaaagcaaggggcactatgtttctttgttcttaaggatggtagcctatctgcaacaactgtagtgtgatataaaaatatataatttatgttgctgacagttacaaatactgcttgcagtactttgtaacataatttttcagattcaagttcatatactctttttttccacatcaccacacacatattttcagacttcctcctcatccttcttcttgccagtagttgtattataattcctgccagtagttacattataattttggttatatcaatattgagtttttatgggattataactagataaatgccattcatagttaagtgatagagtatattgtgacttttttcctgcatgttttattttttctggacttcacagttgtctctcttttttttaaaaaaattagttttcaatgttcttagctttaattcataaactcacccctaattgtataaatctctcaacatgtttaagcacatttggcattatatcaattttatcttttccaggtgccttctaatctgtcccagtctggactaattgttcttcctggcttgctgtatggctgtctactcaagatgtcccttcaccatcattctagggattcccttttcctctcttgtgggttagattcttcagttcttggagactgtcatcttctttcatggtttcccactcttgttttggcggagcacatctttagtaacttcctgacaaagtgtatggtttgagatttcgctgattttaaaatgcccttattatatagtcacacttgatttatagtctgtcttggtatagaattctaggctgagaagagttttccctcaaaatcagaaggttttgcccaattgttttttagctgctagtattgctgttaaaaaggataatgtcattttgattctagattcttttatgaaacctgtttcttctctggcagcttttaggatcttctgtttctttggtattcagaaatttcatgagatatgtgtgcttctattttggtcttattttcatctgttttgccaggtactcatgcaactttccagtttgaaaactcacatccttcacttttgagtatttttcttgagttatgtcttcggtttcttctcagtgttctctgtttctggaactcctaaaatatatttaacatcctgaactcttagtttttgtttagtcttctgattttcatttgtctttttattctgtatattctgttaattcctcggcttcatggtcttctagcccttcttttgcctatcttatggggttgaggattaaacagtttatatacctgaggtgcttaggatatgtctgtcatatagtaagtgcttgtgttagctgtaattgttgtttactttcataactgtcttgagggaaaggtctttggtcttgattctttgacttcttggctgtacatgaccttggacgagttatgtaatctctttgagacctacctccctcttctgtatagtgttaataagctctagctctcagatgtttgtgagggtcgaatggagtatatatgtgaaaatgtttaatacctttgtacagaattaatagttagtacgtggatctttcaaatatcaaaagttttcagtttgatgggaaaatgatgtctgaattttcagggttatttttaagagtacttgattatgactgtcttgtaaatctctatgagctaggtatacttgcactaaatgctaatgctttttaaagaagttatgtcttaatattcagtctcattatgttaggttgaagatagaagattatgaaaatattctctgaaaagctctggttttacttcagattgtataaatctgtgtaatgtaataattatttaagaatgacatgattactactctaaacccatagaaggggtatttgttggattatttattttcacttaaatggtatttgagattaggaaaaagaaaatctgtcttttggtttttcttgatagtattaatgtaatttcaaatgttagctcatttttgttaatggtggctttttgtttgtttgttttgttttaaggtttttggattcaaagcataaaaaccattacaagatatacaatctgtaagtatgttttcttatttgtatgcttgcaaatatcttctaaaacaactattaagtgaaagttatctgcttgttagagtgaggtagagttaaagatacattttaacagaattgtattcctaaaccgattaagtcaagaagtccaagagcattgttagatcatttagaaagtgtagtgatgaggtaaaacattgttggcacagattcatgttacttgatctgctttaaatgacttggcatctagcccatatttgagcccataaccgtgtggtaatttgaagtgtaattcacagtagagcttctgttaaagcactaatagcatcttccatggaggtatacttcagagtgaatataattttgtttatcctgtgtctctagagctattgactgaaaaagctgttagggcattctctaactgtacatcacctaagttatttaaaattgctgaattaggtggcttgtcttgtctaggacagagttttaaggactgcccacctgattgatagagctagttgaccttatctttaactttttgtttttcttttgactttgggagtagagatgtgaaaaggtaaaaaggaaggaaggaagagaaaacttaactctttttgcccatgaagactgtttttccttctcaaaatattgactattttctgatttgtaaaaatcggcacataaaacgtgttattttttacttgacttttatctttcccatgtgatatctataaattatagataggaaaaatttatctgtaatttagtgatctttctagtgtgataaaacgtcagaagtactgagagtggagtggacattgatattgttactctcagtaagttttcactgatttttctcagagtcatgaaggaacaaacgtttgttaagtccttatcacttattagataacacaaaacatgttgggggggtgtgtacagaggtgagtaagatgtagctcccattctcaagtcgcttacattctaatgtaaaaggtagacaaagcattacagaagaagtaactctgctatagaaggttgcaatgaagagaacattggaaacactaattttaccttataaagaaggtttcataaaggaaggcaagtttgagctggggtgaaaaggaccagtaagggttgactttcaagccaaggagaggaggggaagtgatgttacaggccaaaggaatggcattgtaagaagcttgttggcataaaagtgtttagaatatggcagcgaattcattatcatcagattgtggtgtctgtatgttgggggtgggagagaattgtggtggcaataggcaacaagataaaagaaagtaaaaggtgttatggaaacttaatgggtccagcttacaaatgatctatgcatttaggggtctttctcttttcctgataaacctctcctacaaagagccttgttgcggataccatagtgtttctttggaggaaaataaaaactacaaagctttgtattttttgcacaactggattcagaatataagtaataaaaaaggacaagaactttcaaaagctagaagccattaaactgagtcacttcagggttagactatcagaactggggatttagaaagtctcagaatggaaatcgaaggacaccaaagacaaattcggcctttttcaaaattttattctagtttaacatattcaaagaaagggaaggaaattcttttcattcctgtgtgtagtgacttcctgctttaagaacttaggacttcagctgtactatcagtattgtaggccacttaacattattatggttaaagttggcattggagagagcctaggaacctaactgcctgtttgtttttatatttccaaccattggattcccaagttaatgaagtctgtttattagttgagggtagctcttaatgcatatattttaatgccccttccccacatggaatcataagctttcagaactggagagtacctgaaagagatcatttagtccaaccttctcattttacagatggggaatctgaggcctagagaagttaagtgagttgaacaaggtcacacaggtacatatggtagccgaccatccactgtttatgccaatattccctttacgttttgcttttttgcttgttcgttttaacctctccaaattttactgacttcagaagtttctagaactaagttatagcatgttttgagttctaatgtcactttccgatcttctttaccttttttctacctctgtttgtatttctggttctggttaagtgagtctggtaagcagcaggtgttctattttatttcttttatttttaggatagtattacatgtgatatatatgtctttgcaaacatacataatttgaagatcttaaaatatttgcactaggcatacccacatttaatagtatgttaaatcttttatagcaattatgatatacatgggtgaagaagagttcctaatatggcctttctgattaactgtatctgtttatatctgtgttttcttcaggcattcataacattaagcaaattcaggtgtactgttacttaattgaattaatcagtttgttttgtacaagtatattttatttttgttccttgttgtataatctggtaggaatggggaaggggagatagtgaataaagagatgtatacttcttgcctttgaggaatttaagttttcactgtataccaattttttaaaggtatttactatatttcagtgcatattttatttgacatactttatcattttgtggtaaacctttagctttactaattttcatctattaagttttcttttgtaagatggtgatagcttcatcaaagagagtaaagaagagacctgcctacctagctgattctatggcaaatctcacttctctggaagcttttcctgttaatcttattccttcagtttctgcctcttgtttcataaaaactcattctttaaatgcttattcatttctcttgtctcatataaaccaatatgaggtactggtatcttttgagttttagttataaggaagcataaatggttaaatttaaatggctaaaccccatttgccatttgtgtatctttaattttagtttgttgagagacttatcactaccaaaccacaaagaatttaaaagaaactgtcagtaggtataggtggaaggagggcatttatcagagattttaatttaagaagaaagtcttcatccttatcctaccaacccccattccctgagcatatttatcattactagtcccagcatatttgctcccatatttcctatgcttacctgtgaagattttcataactttttccttgctttttactgtcactgttggttctgtgatttatgacagatactgctcttgtaggaatgctggctttgactgaaatttgttactgcttttgtatttaaaactttttttttattataagtagaattatggaacagtagtagaaaaagtttgacttttgtaatcagagatactgagcttgagttctggctctttcatttgtatactgttatttggggcaagttttttaatgctcttaagtcttagctttctcatatataaaatggagataataacagttatcacgtgattgtgaggatgaaacaaaaaaaagtggaaactctttgtaaggtgtgttcatctggttgacacttagtagtcattacttccactttccgtccatatagtcctcttaacagtaatatttgagaggcatttttattaaagcagtcttaaggagtgttcgtcaaaccacatgttctgggatcctgagaaagtaggggaagtttagagaactgaagctgcacaaaactaatgtttattttctgttgtgttgtcctgagaccagcttcttagattgtgtttcctagtcctacatctctgattccttataaaatattccattatgaattcttcactattgacaatttctccccttttatcttaaaagtaccaaagaaagtgtaaaatgtgactgtcttgtcagtcctctttttcctgtttttcatgtcagtgggtatgaaattactagcaaggatgcatatatgtgcatatgtcattactaaatgcattttctttctagaaaaactcaatatactaaattgtactaaaaaggaaaagcttgttttgttttgagtggtagtatgaaagttgttttattttaggtctgaccagttagaaaccaatggattgtagtttatttataattagttaaaccttcatgtgaatttggttttgaattacctttaaggtagagaagaaactatatagatgtttttcagggtttctaaatgtacaatacaggttcacaatcacttatttgaaactcttggggccaagtatgtttccattttcagaaattttagttttcaaaaggtagcacagataaatatacttttacataaacaccccagtggggtgtgggtcagtacctgaaatgaaatgttttactcttcgctctaagtgtattaaatattatgtacaatcttattacttcagatcaggatttgctgtagttgagtttgccataaaacttaagagaaaattttagatgttttgaacttttgggatattgaaattgcaggttaaggagctatggacctttatttgttttaaaatgctaagagtttattttaagtaatttttaaaaaatttgttttgcatagtagttggagttaccagggtactgctaaccacactgatatgtaagatctctttctgagccttttattgtttgtaaacatggcctgttaatcattagaaagccagtacatactaacatatcactgctattaagacaaatattagcatactctagtaatgacaagtcagcattttactattctgtattgattttacttattctttcattactctcatactgtaattaaaacttgcaatctgagagactgttgaaaaaggtgatcgttggcttttcaacagggagtaaggtctggtttaaaaaaaaattagtaagcatttggccaagtagattaacaacattcagtttttctttactgtccttatgcttttactatttttaacatatatctttttgaagaatagtttgagaattatgtatgcttaactatgagatacagatactattgaaactagtcagttgtttataggtacttgtaaaattaaaaatatattccaatagcatgcagatttttcatagaggaaatttgaaagcatggaagcacctgaatttacagtactctgtattagtggcatcacaagtttttaagcaaatgtattagctctaattgcatacacttaatcttttaagctttggttttattattataatatgggggtgataacagtatctacttaatagaattcttgttattacatgaaataattaatgttaaacacagcataatatgtgtcacattataaagattcaggcaatgtttgttagtattagtacttttttttcttcctaagtgcaaaagataactttatatcacttttaaacttttcttttagttgtgctgaaagacattatgacaccgccaaatttaattgcagaggtaggtatgaatgtactgtactatgttgtataacttaaacccgatagactgtatcttactgtcataacaataatgagtcatccagattatcgagtgagatacatatttaagaattatctttaaaaatttcaaaaattttaattttactgttgtgttttaggaaaaagtattgcataaagctattaatattgtcaggaagactaaagtgcagcatagactaagaattaggaaaattcctagactaaaaatagtataaggagagggtttacctactatttgaggcagttggtctaatagtaagcaatcacagggagaaagcagaactacttaactcttctgtgttgaggaatgacataaaaggtaggaaaggatataacaaatgttgataagaggagtctgatggatgagaggagggaactgctttaaatgagtttctacttcagacataagttaattctcagagcccacaaaaactttcacttttatttgtgaaatacaactcagttctcatggcttaacactttaaaccatgagaaaactgaagagttgagaagcttggcagatgctgctgtgatagtcaaaaagaaagtgggtgccatgagctactattgatgtatttgccattgatccctcctgaaaatctagaatggactttcagacaaatggtttgaaaattctaaatcactaatgattgagatttagtataggtttactaagaacgggttttttttgtttttgtttttggtggatttaggctgttgcttactaagcaaagcaggctttagttgaggtttatcttgctttaaacagatatttaacagattttcctggaggtttttgtgtaccactgggaaaatgaagttaggcagatgactaagtgaaagctgtcctgctgactccttataatgatagtcattgtctaccagaagatctctcctgtcacaccaaaggataattgattatatcctgtaccatattatgagtcacctgattggagatataagacatacttctcacatatttagatgacacaggttagtacattgaatatcagccagggtttttaaggatcttaatagagtggaactaaggtagaaactattaagagcaattaatagtgatatatctatagtcctgtttctaaacaagtttttttaaaaacctcaactctgactatagtgaacagagaagtcttggactcttacaattcatgtgagaagacctgaaactttgataacaattatatacattttgtgagtaatttctttggtgtatgccttcacatatctctggtatgtgacctatgctgcagtccattgagcatagattcccagaatgtattctcctgcagaaaatggaggaaaataatacttggcttccctaatgattacatgtgtatacaacactaacatttgcaagaccacctttaaataacacacttagcatttttattttatgaaatgtaatatgtagttctttgcatagtttatcctattagtaatctattctgtctttggaatatgttttgtgatgatgaaataaatactataaatagtattattccttttgcattgagagtcctgacgaaatgtccatgtgacagttcattttgggtttagctctacctctaatatgtgacctatgctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctccccccagggtgaaagcatttaagatctacaagctacaattttcaattatacaatgttattattaactatagtcactatgctgtccagtagagcttcagatcttgttcatcttgtgttcctccctccccaccctcagtccctggaaaacaggttttaaagatagttgctaatccttatttcttctaaatttttaaatcagttgctgcctcaatttctatatgagaaatgactgattgatttcatttttctgttcacgctaccattttcatatcatactagcacatgttacccattaactgtattgcagatttggtctcacaaaattcttctaaaataacatttttaaaaagcatattaatcaaaaataagctttatatttctgaagcttgtttgagcatagaatgcctttggataaaataccattacctagtaaagtgtgaacttttataatccataaaaattattcttttataagaatattcataaatgtagttagattaatagaagattctcgattctttgatcagaaaactaaggactatattgaaaaatcagtgacaaatttaattcttatagtacatctgaaagaaaaaagaaaactcttgggagaacttttacagtgatttaattttgctgttgatatatttctttgggtggtaagtatggcaaaacatgttaaaatttaatgcaaagagattttgtacatttttccatctctaagaaggacaaagcctaagcccctccagatagatagaaaaactcatttagagagttctccttcatgttaatctaatttcttcttaattcagctgtaaaacagaaatagaatgatcgtattaatcatttaaagctgtgtaattgcatagattccttgttcctttaccccctcttatatcttgtttcctatcctttgtgactttttttgcattatatataaggatgccgaaatactgtttattgttgatagtttacaaaattgaatcttacattagtgcataattttggtgaatgttgaagattatggtagattgccttacatttctgcatattgtttgcaccttggaatgatagcactggcatgaattatagagctgaggatctaaagatttttactttgatttatcccattatcatctgcagggaaacaattgcttttactgattaaaaatgcaggctgggcacagcggctcacgcctgtaatcccagtactttgggaggccgaggcgggcggatcacaaggtcaagagatcgagaccatcctggccaaccaacatggtgaaacctcatctctactaaaaatacaaaaattagctgggtgtggtggcgcgtgcctgtaatcccagctactcaggatgctgaggcaggagaatcgcttgaacccgggaggtggaggttgcagtgagccgagactgtgccactgcactccagcctggtgatagagggagactccatctcaaaaaaaaaaaaaaatgcagtagcaaaagcgatggtagaaatttaaaacagagttgatgagcagcatatattttggtagtggaaaaaaaggtaaaaaattttttgtaataaaatagaaaaattttgtaatgtggaggcgcagaacactagatttaagccagggggtcttaaattgtgttacattccttttaaagtctgatggaaggtataaatgttctcccctcaaaaaatgtgcatagtgtacataaaattttgcagtttttattacattgaaatatattcttttagacagaatgtaaaagaaccttcatgaaaactatgtcacttttttatgcaaaaaccagtggctactacatgagagcaatgaataaatctaagtggtacaaattaaccaaaattaagctttagttctgttcaatactaaattttaatgaaaagactgctatttaacttttaaaataacaagttgaaactatgctctttgactttgactttgcaacttttatatgatctttgatatccaatcagtgttgactttggtaaaaagtgctgaaaatgctattttacaaaagaaagaagagtaaatggaatctgtagattctattgcctgatgaaagtagacgtgtcaagaaataagaattctccaaggctcttcagataaattcatgtttcatcattttctttgccttcaagttactgagatcatttttggcaagatctgtatcattaatgctgtgttaggaaagaaaagattatgactccacattttactttcaaggttgaagagttaaactgtttaaaaagagtgtatgttatcctgtaaacagcagtatcaggctgtagaatttgtcttctgaaagcagggaacttatatatagcaaagaacttcatagtgctcccatttcttgacaaaacctctcgagaagctcttgattgaaagtcttggctttcatgaatctggcagctttcacaatagtggatttttcatgacaaatcatcttacacagggaattattcaagggttggcacttgaaacagtagaatactttcacaacaagagataagatttctttcaggattgatgacagtcttgcaccctagcgcatactgatgaagagagcagtgggtgaccatgacatggagagcttctgtctttaccagtgccccaatatcagatgtgttgtctggcagtaaggtgtactgtctgcctacagaatactgaggtttcttcaggagaagttttttggtaaagaaactttaccattttgaaagtgttaatgttttctgaagcttccaaaaagattccaaaatgggaatgtttccttgattgtgtcaccatgcttgcatttgatgaaaacttgtagccggctatactgagaaatcatatctgaagaaaggtggtacttccaatctttttgtgacctactttattattgtttttttaatgtcagggttttttttggaatggagaaaagtatttgatagaggtattgcaacagtcttattcttcttcatgctacaagtatatttgactctttctaagatacttgccttcactgttcaactgtgtgactttttgtttgtttagcattacaatcaatatcctagtaggatgatttaatcaatgatttttaattggaacaaatagtttttgtaatggtctaggcttttccaacttaactgtgctctcacatgtggtctctttttctccctctttcctccttcttatacactctcacccacacacatatgcatacataccctgtctgatgtatctgcttcttcagaatagttggctgtgctctgctgatgatgagaacttgccatttaagaaggacttgggatagtccatgtcatcatgttcagggataaaagtaaaacccaagggcatttaaactttattgtattttattttctgtttccagtccaaattaaatccaagagaaggctccataatcaaaaagtaaggacatattttaaatttgccaatgggaagatattctagtcattacagtctggtaatactatcaattctgtttctcttcagaggtgaggggagactatttgatgaaatcgtaagtcctgtagggtgttgtgaaatagggccagaatgaaagatagcaagaatagtgttatgaaaataaaatgcaaagtttataatatcatgtggtaaaatgtaatagtatttacttcatcagtagaactgctctagtagctgtatattctccatccttgcataggttggaatatcccccaagtgaaaagagattgatgggctaatagttaatagaaaatggagatctgtacatacagtgttaagaatgtagatattaaaattgttatatttagctgttacataatattaagactcagagttaagtaatttcactgaaattgattgctttttgtgtcttggagtcaaaataaataactgaaatctactatacttggctcatgcttaattaatatacttagaccatatttcggatgaattattcacagaatctaaaggagtatcctcgtgttcttaccttctttatccctgtgtttatttaaaaaggcaaaaaaaatggagcagatgctgttggttgaccatattttactgaacagtagcatttgtgtttaggttgaaacagcattagaaaactagatacggattaaagtcagtggtaggtttttttttttttttcttccaggaatgtttcttatagatgatcaaacaggcacaggaaggggaagtgttgtgatcaatattatccagttaatattagcattcagaggaaaatttgagtcctctgatacactgttaaatttctttctatactatcaagtccacaaatcctggaactgcaaaagaattttgagactgttcaaaataattaatctctgtataggctcaggctttcctgcaaggttatgaaatgctgataaaattggtcttattttgaaaggctcctcagcttatacctttccttacaaatgcttccttacaaatgctaaagcatttaatgactcctgacttaaagggaatttggacagattgaggttgttggtcttggaaatataatactgcaggcttctgtaaaatacttgaaatgtaattgttttaaaactttcaaagataccacttgtttgcctgttggttagaatactggtgaaataatttttaatcttttatgaataactaatttcatcataagaaaacttagctaagcatggtaaagctgttgttatacaactgtggaattcttcctgaggagtaactatcttataataaatgtagttgattatctaaagtagttttattcttggaatatctcataataggtttattctcttcttgtcagtatttccttgtagattgagcctgtggatttgcatttttgtaattgtgaatcaccattataggagatacatgcattttatctacttttcagtttgtatggggttaactttattagaattatctttaatgttattttgcttatatccttaattttaattatagacaaacattaagaagctggagaaaattatgttctagtgacatttatatagaagaagaatcttttttccccctttcttttttgaagggagatgaggcagtcatattttggtaaagaatttgtagactttgcagaggtctcttcaaaataatctggctcagagtcttgacatatcctcagcagacatggtgcaaattagatggcagagtggtgggtacaagttgaccataaaataacgcattaggttagtaatgcccaaataatactttgggttttcagtgttgcagagaagtcagacaactgatagttattataaagaaaaatgttctgagagtgaggtaaccgcttaagggaaggaagcctccttctgtcttattcactaatttacaagaagataattgtgttacacttccttaggagtcattcatttgtatatttgacacttttgctttatgaacatgtgaagattattcaaaagtaagctgttggtgatttttttcttccaagaaagcatgccacagggcaacttctagggttggttctcatctagtcctgtgctccacactatctgcatctgcacttaagtttcaatattagataactcacatgtttaaactatgaagaaagagttaaaacatcctgagaatgctagtaagtatgtatttttgaaaggacttccaaaatttgagtttaaagaggtaaactccttttacatgacaaagttacttagaaacactactgctgtttccctctcccttgccttctccctgtcccatgcatacccccagctgtgttccagaatgatggcacataaagtaaacattcatatttatttccctttttttgttttttttttttttttttttttttgcttgtttgttttgtttttttgtttgagacagtctcactcaatcacccaggctggagtgcagtggcaacatctcagctcactgcaacctctacctcctgagttcaagcgattctcctgcctcagcctcccgagcagctgggattacaggcgcctgcccccacgcctggctaatttttgtatttttagtagagatggggtttcgccatgttggccagactggtcttgaactcttgacctcaagtgatccgcccacctcggcctcccaaagtgctgagattacaggcatgagtcactgtgcctggcctcttattttttctttggttaaacttttagggaaaaagtttgagctgcttttaattttctttttgtttttaaataaattattaaagtttctctatgttaggaactcttgtgtacatgagttcattgagcttattcttaataaagacaaatcttctagaaataatagttgtatctttaaatgatctcaaggaaaatgtttggtttctctggggaatgaattttcatgacctaatcttaaatcaggttattttttctagcctgtttactaaatttctacatgttataacctaatgaaattttcttacttcctctttatttaaaacaaactataattactgtctttttaaaaatcttccaatgtggcgttcttatttttcttaacatttgaattttcctgggccaaaccatgttactatgatacacattatttaaggctgttatataatacagtaaaattgtagaactttcataccttgaaggatcttagcaattatttaattcaaacccattctaacatagatgataaaacagatttgcagggttgggcacggtggctcatacctatattcccagcactttgggagactcaagcgggaagattgcttgagcccaggagttcaagaccagcttgggcaacatagtgagaggctgtctctacaaaaaaatatttaaaaaatagccgggcatggtgtcacgtgcctgtagttccagctgcttgggaggctgaggtgggaggattgccagagcctgggaggttgaggctgcagtgagccatgatcacaccacagcactctagcctagagcctccctgtgtggcaggctctacacttcagataggcaacagatcgagaccttgtttcacaaaacgaacagatctgcaaagatcaacctgtcctaagtcatataatctctttgtgtaataataaaaaccccatcttctaaccttaaacctggtatttttttctacgaaactatgttctgcagtccaaattatttttctttattattttgaatcctaaagtagaaatagaaacttagaaaaataaaaagcaactcctttatgacatatgaggactttttcagttttaaataagaaaaacccaactcaaagtagcttaaataaaaggagacattttttgacttacataacctaaaagctctggcctggatctaggtgctcaacagatctcaagagtatctctcttattctctctccctcccttaccctcctcctcttttctctcttctgtatatatgttattttcaaacaggctctcacaagtagtggcaagatatagttcctaatagcttcaggtttgcattctacctactttagcaactatgatgagaagagagctacaatttgagcaaaaatttgtagggtgagttctgatttccctggattgaggcacatgcctattattcctgaaccaaatattctgtccagggaatggaattctctggggcatgtatctaaagctgaagtgtagagcctgccacacagggataataatagttttccaaagaaaaatcaaggaggggaaagaatgttggaaagagaaaaaaatatcagttgtctgcttcacatttgttctcaataattagtttcatagaagtgaaatactgtgtaacaccctaaactttagagattcttcgtagacaggaaaaataagaactcaatgaagttgtgacttcattcaaatcacgtagtttatatacatgctattagtaaaacccaggacagctgagtacaagttttacccttatattcacattgaggtccagatcctggttttgaatgagataattacgtgcagtcggactgttttctgatcctaaaaatagagacaataatatctatcttgtaaagttatggtagtgttaaagatatataaaatgttggcaagtaccttaatatacaataactactgctatatgttgtcattgtaataataatcatatttcttcctttgttgaattgctttcctgtagtaatcttattgtgatcatcctgaaacatagatttccgagcttcaagcaaacactattatgttgaaaaatctacattatttctaagtttagcagtgccagtggaaagtttattgaaatagaaaattacttttttaactgaggagtgtagattgtgaattcgtgattcatcttcttaggagatgatcggaatattgataaatattgatgcatagaatatgaacaaaacattacatatcttgtgctgtgatattaaagtagtattctgttctggtagtagtatggcagtattttaggtctgaaagatgtacataatctgtactttgaagtctgttttttaagagattaatcacaagagatttacataaaacaactaaggttaaaaataaatggtggattagagatacatcaggcaaatttcaatttcaaaagcagatgacagaatctcagtatcagggtagcatttaaagcaaaaagcattaaactggatcaaaaatgtcattttacatcaacacagggtacactccaggtaaagacttaacagttatgaacgaatgtgctaaacatcaaaatgtattaagtaaaagctgaaagaaatgaagaataattggtagaaaagcaatgataggaatccttaatgtacttcaaaaggcacgaagtaagaaggtacagtcatgtaccacataatgatgtttgagtcaacacctgacctggtatacgacaatggtcctataaaattataatggagctaaaaagcttctatcacctagtgatgttgaagccgttgcaatgcaatgtatcactcacatgtttgtggtaatgctggtgtaagcaaacttactgtactgtcagttgtataaaagcatagcacagttatgttcagcacataatactttataatgataaacgaatatgttactagtttacgtgtttacagtactattattttagcatgtgcttctgcttattaaaaaatgttaactataaaataatctttaggcagatcctacaggaggtattccagataaaggcattattgtcataggagatggcagctccatggatgttattgccccttaagaccttccagtgggacaagatgtataggtggaagacagtgatattgatgatcctgaccttgtagaggccaaggctaaagtatgtatttattagtttttaacaagagtttaaaaagtaaaaaaaaaaaataaatttaaaaatagaaaaaatcttaataaggatacaaagaaaaaatgtttttgtgtagctgtgtaatatgtttttgttttaagttaaatgttacaaaagagtcagagttaaatttttttatatttataaagtgaaaaagttataaaatgctaaggttaatttactgaagaaagaaaaaatttttaaacagatttagagtagcatgtttataaaatctacagtagtttacagtaatatcctaggccttcacattaactcaccactcacccactgactcacccagagcagcttccaatcctgtaagctccattcgtggtaagtgccctatacaggtgtacaatttttatatcctttataccatttttactgaaccttttctgtcttttagatacacaaataacattgtgttacagttgcctatgatattgaatacagtaacttactgtacaagtttgtagcataggagctgtatcatatagcctgggtgtgtagtgaactataccatctaggcttgtgtaagtatattttatgacacagtgatgaaatcatccagatacagtttctcttaagcaacacataactgtatatatatatatataggtggctttaataataaaataatgaaatatatttctttttttctgtcattgacaaaacaattaccagtcttactaattagatcaactgcaaaacaaaatctcactcaaaaataaaaatatgtaagtcccattccttgattacaattcattagaactggagatttttaaaaatgtttaaatttatatggaaatataaaatcatgttttaaataatttttgattcaatgaggaaatgtaaatttagaactaaagattaataactagagatttataaaggcaaaaatgttaatgaattaggaaacagtaaaccatttgaactaatctaaatactgattgcatgaaaatgccaataaaatcaatacatatttttaaaagccagtcaaggataaaagaaaagagggaaactaaaagtgagacattaagtatgagaaaggagataaaactaaagtgtggaggtgatgttaaaaattatattcaggtctgtgctaatcattttggaaatttcagtgagaagtgggcaattttcagtgaatatatcattgtaaatgctttgaggagagacaaaatctgaatagaccctgcaataatgaaaatgtctaggagccctcaagaaatacctggtttaaattgcatttcaggtggctggttatcacaccttgaagtatcaagtaattatgttatctaaattggaccaggtgttagaaaaatatgtgagacttcacaggtggctgcttatgtagcccttataccttaatctgataaaggtagcatatatttaaaaagagagaaaaccagaaggtacaatttagggaaaattaaatacttctatttggccaaagtaagagtacattcaagggaattgtgagaggtaagagtggaaacagaggttggagctgtatttttatgctgtgattgaattacagtgtgtgataaatattgctcttatttgggtagattaccatttaacattttgaattaattggtaattggattaatcttaacttttaaaaaactaatctgagagtggtataaaggatagattacagaatggataaagggtgataaatcagttggctatggcaaaattgcaggaagaaactgaaataggccacagaaaactgaaactgacattttgagtagtatttcagaatcaagatctggattttggcaactgaatagatgcgtaggaatcaaagatgagtatactaaatgaacttaatctatgatttgtctgtcattttattgtgtaccattagtgtgtatgcatgtatgtatgtgccaggtagttaataggctgactgtgtctcttagctccactctgctgcctgggcctttgccatagtgctggagttccctcacttctcttttctgtaaccctattatattactgctgtctctcagctgtgtttcattcctcaagcagaaagaagatgggaggatcatatagtagttgactagaagctgtggagtttgagtgctgggattatatctagttccattacttatgaagattatatctagttccattacttcacctcatctataaaatggtttaccaatagtacctaccttacatggttttatgagtattaaattatgtatttctaaagacatttagaacaatacaaagaatatagtgtgggctcaataagtgacgatggtgttagttattagaaggccatcgagtgctggagaaaataattgaatatcattgatggaaataaaggaagttttccacgttaaaaagcttcggtttttggaaatgtgtgttttcagtatttctgagattaccaggtagaaattccagccagatgttggaattctgcactggcagttgggaataaagtcatgttaaaggagataagttttggagttattgtgtaaaattggtaaagcactggaatagattggtttgacagaggggaaactctttttgagataggcctatatttagggacaagagaagagacaaccaataagggttgaaagaaaccttgagagagtaagtcctatgacagaagcagggaagtttcagaatgattgcagaaagatcagccaggctcttcctgttctccatcgtggtgcaggatcaaggtgaaaaggataaccccatgcaggaattttgcatctgcaggctccgcttcaacatctgtttaggagaaagtggagacagactgacctgagtaactaaggtcttggaacagcttacaggtcagaaccaggtgttttccaaagctagatatactgttagcgcctttggcaacagaagaaatgaaaagactgttgtctgctgcacagttcgaggggccaaggcagacgaaatcctggagaatgatctaaaggtgcaggagtgtgagttaagaaaaaataacttctcagatactggaaactttggttttgggacccaggaacacattgatctgggtatcagatatgacccaagcattgatgtctacagcctggacttctatgtggtgctggaaaagccaggtttcatcattgcaggtaagaagtgcgggacaggcttcattggtgccaaatagaatcagcaaagaggaggccatgcgctggttccagcagaagtatgatgggatcatccttcctggcaaataaattctcatttctacccaaaagggtaataaaaagttttcagtgaaatgtttaaaaaaaaaataaaaaaaagatcagccagcagccaggatgggattgtgaaaacagcaggaaattagttgttgacaaagcattaatgaccattaagaaatcagcctcggctgggcatggtggctcatccctgtaatcgtaacactttgggaggccaaggcagatttcttgagtccaggagttgagaccagcctaggcaacatggcaaaaccctcgttcctccttaataaataaataaatgaataaataaacaagcaagcaagcagggcttggtgttaggcgcctgtactcctagctactcgggaggctgagggggttgaacctgggaggcaaaggttgcagtgagccaagattgcactactgcactccagcctgggtgacagagtgagaccatggcacccccctccccttcaaaaagaaatcagcctcataatcaatttctctggattaaggagtaagagcgtctcaagatttgctgtttatagagagggaggctaatagtttgagagagatacagaatctagggagagtgtgggtttttggtctttcagttgtttgccagccttggataaagaatgaagattacttgagcatattatttagagacaagtggagagaataaaggcacatgccagataggagataattaataaagcacttgtccaaaatagaaacttgttgaacaggaagagacgtcaagtataaggagattttaagatgggagaagggaattttgagtgtttgtattggatgacctcagggttcccagtaaagcaggagctgaattcatcgaaggtgatgtgttggtcaggatcaagagagaggttgggagaacaaagtgctaaaatcgttgtggtcaagagtttaaaaagtgtataccagaagagttattgagtgataggggtttgaaataggcaaagctgtaggaaagggggctggaaggaatattaggaggaacactaaatatacttctgaggtctacctcctggtctgtgaacataaaggagctgaaagagtaatggctgaagttctttagtttagctaaagttttttagctaaagctagaattgttgaaagttgtatttgaggaaaaaaagttaaggatacagttgaccgttcgataatgtagcccactgttgaccagaagccctacccacaacataaacaggcaataacacatattttgtatgtgtattatatagtatattcttaacaataaagtaaactagagaaaagaacatgtatcaagaaaatcataaggaagagaaaacacatttacagtactgtactgtatttattggtaccatacatttatgttgctgtttacaagatgaagcatctgtctgaaatggccagcagctacagctgtacctatctactgtacatatcaagcaagtcactttattcttataatgtctatgacttctttctttgaaagcgcttccatcatcactgttggcacttcatatgggtctcatggtgttaaggtttacggcattgcactagacacaatgaaaactacacaagagggccgggcacggtggctcacgcctgtaatcccagcactttgggaggccgaggcgggcggatcatgaggtcaggagattgagaccatcctggctaacacagtgaaaccctgtctctattaaaaataaaaaaattagccaggcatggtggcacgtgcctgtaatcccagctaatcgggaggctgaggcaggagaatcgctttttcccagaaggcgtaggttgcagtgagccgagatcgtgccactgcactccagcctggatgatagagggagactctgtcgcaaaaaaaaagaaaagaaaaagaaaagaaaagaaaaacacacaagagccgtgagagagatagcttttgattgcaatacacaatttactggagagatgagctgatcatacagagatgattagtgtcacacagtgttttaaacagattcttgcaaccctggagttcactgcagtagcaacagaagttagctatgagattttaacagtagtatagtatgtactacagttaatattaggtagctatgatttaatgctgcatctttgcatttgtttacatttatcttgactacaagtggtattatgtctggtcttaaggtttgtgtgcatatgttttgatgaattttaactttttataataggtttgtgtatattttatggcagtaaatgataaaacagactaatctacatatattttatgtagtcatgacataaacctaactttttcttaactttttgatatttctagtctatgtgtttcatctgcaggttttttcaaattgttgaaatctctgaaaaattttattgaaaaaaaatccatatatgtaagtggacccacacatttcaaacctgtgttcaagggtcagctgtgtaaataattttcctcaaaattaaagtggaaaaggagagttactactagtagaaagtagaactgtacccttgggcaggggtgtgtgtgtgtagttaaagatcaatttaacttaaaaggtcttggttagagaataaaaactggcccttattagctttaatttacatgaaaaatgaaaaattttaggccaggcacagtggctcaggcctgtaatcccttaactttgggagaccaaggggagtggatcacttgaggtcaggagttcaagacagcctggccaacatgctgactcacccttccctactgaaaatacaaaagttagccaggcgcagtggccatccctacagtgctagctactcgggaggctgaggcaggagaattgcttgaacccgggaggcaaggttgcggtgagctgagatcgcaccactgcactccagactgggtgacagagcgagactccatctcaaaaaaaaaaaaaaaaaaaaaagatttgaaaacagagtattttttaatctgcaagagctttacagccttttattcatatgtataagcttttaaagatgactaaaattttagtgtggactttccactcattggaaatcctatattgcaggtgttaattcaattttagtgagtgtgcatcatggctcagagagataggactagaatgaggaggtcacattggagactctgaaacagatacatgtgagcctcccaactttttaatatttgttaatctagaagtgttgaattttgggtgctgacaaggcagcaggtagataagaattgcaaagttaagaaaatagactgtaatattgatggtaaactaattgattaaattttaaaatgtacttttccatgtttttctttgaattgtcagtaattttgtttcaactggtattcatacatagattattcacccaatgttgacaactagtagatttatatattttttatgttgcctatccttttttgggtaaggattaacagaatgtataatcacctacattataggtacactactaatcacttgctacttgaaaaaacctaaagctttgaaatctttttattattgcacacaaacttatgccaaaaatggagataaagagaaaaatgtcatccactaaaccccaacaaataatgttgacaatgtggtctactcgtagactcgcattgacttaatttttttaaatcttattgcatattttgactagataataaatgcatatggttaaaaaattcacatggttcaaaaaagtacacctcccactcatcttccatgtgatatttcctttctgcttagcaattctgtatttatcttgctaaacatgaatgacagttgtttgctgaaattacattaaatgtgacgtaataaaatcattgtaagtttacattttttaactttaataatttttaatgttttaatgaagagtatgaagagtagtagtactgctcttcaaagtactactactttaccttaccttttactgttttgttaagaaaattaggccgggcgcagtggctcacgcctgtaatcccagcactttgggaggccgagacgggcggatcacgaggtcaggagatcgagaccatcctggctaacacggtgaaaccccgtctctactaaaaatacaaaaattagccgggcatggtggtgcgcgcctgtagtcccagctacacgggaggctgaggcaggagaatggcgtgaacccgggaggcagagcttgcagtgagccgagatcgcaccactgcactccagcctgggcgacagagcgaaactccgtctcaaaaaaaaaaaaaaaaaaaagaaaaaagaaaattatatagaaataaaattccagctattccaaaactgcaccttgaatacaggtacagaattgctaaaaccgtgtaccattttgtagttttagcatgcttttgtgtaactgcatctggtgtttgatcctcatgagagccctgttaaggaagggtacatattattgtcctcattttccttcgaaaacacatcagagtttgtattttgactgtcagcattcaaatacaagtcttttatttataaaattttggtctttatactgtggctaaaaatcttaaatcacttgtcatgatttgaaatggtttataccgattttttttgacatttatacacacatacacatatttttaaattgtctataataaaatcatgctcatctttgaaaaaatattaggagtactacagtggatacctacatacttgctattcagcatacctggttttttgtttgttttttgagacagtcttctctgtggtccaggttggagtgcagtggcacgatctcagctcattgcaacctccgtctcccaggctcaagtgattgtcctgcctcagcctcccaagtagctgggactgcaggtacacatcaccacgcccagctaattttttgtatttttggtagagacggggtttcaccatgttggccaggctggtctccaactcctgacctcaagtgatcagcccacctcggcctcccagagtgctgggattacaggttgtgagccactgcacctggcctgtttttaaattcacataaatatgttttatatttttcattagggagaagaaggttgtgtctacaatttttaagacattggggagatttagatgccagtagtaacttaaaagagaaataattgcaaattctttttcctcttgagtatactttcatttaaggtacagtgttctgtaagttacttttaccgttaaacttcttaatgttgcttattgtttgtcttacatttttaggttggatttttcttaagtcacatgtctaataaaaaaaacccttaaatacctcatttattcgtcttcgttagtgaatgcattgttgtacatattagatttttctctttagataactcagcttcccctattaagtgccacatgtattacaaaattttatttatgttttattgtttaataaactcttgagaactagatacattttaatcatttgtaatacttacattttctaaaacacttcatttttccctggtttcttcaacaaagagatgcatgtagtacaaggatagctttacctgtgttagaagattgtttcacacatttacatcaactgcatagtcctgtttttgttgggccctaatgccagcatcactttttgctactgctgtttctgccttaaaggcaatatgcctctgtctagtttgctgattctgatactctttcccctggaaagtaggtaatcaagtttgtgaggagctgtgtgtttaaggagtccataaatccttgtggggagccctaggtgtatagagcatagctgtagggcagaggcctttgacacttattctggatatgcagtggcctttgcctatggggttcatgggtcagagcgctgttgtgacctttgaataaatgggttgttatgataattgttttaagggaggagagttattctgatatcctttgtattgatattgctcttatttattattgagctggatttaagtattaatcatttaaggtcaaatttctaatgtatatatgttcttaaatggctacgacccagttaccatagcaatttagtgaaataactataatggaacattttttttcaatttggcttctcttttttttctgtccaccagggagtaactattcccagtcagaggcgctatgtgtattattatagctacctgttaaagaatcatctggattatagaccagtggcactgttgtttcacaagatgatgtttgaaactattccaatgttcagtggcggaacttgcagtaagtgcttgaaattctcatccttccatgtattggaacagttttcttaaccatatctagaagtttacataaaaatttagaaagaaatttaccacatttgaaatttatgcaggagactatatttctgaagcatttgaacaaattaattagctttgttgttcaactcattgggctaaagaagccaaaagcaatgggttttaatgtagtcgaagccaaattatatttatgaaagaaatattctgtgttataaccaccaaatacagcccaattctgactagatgatggaagaacctgtcccatcagaggtccagcatgaggtccagcagaggtccaccagaggagttcagcaatttgctgctcttagggcagggatcaattccttaatatcttaggaagactaggtattgacagtaatggtgacaaagcaatgaaaaggaaaggaagaagtgataagacgtggcagcaagctgaagtatgatgagtaaagaataggaatcaaagtatgtggagtgttagagaaaacctggatttagatccagattctagtcctatctctgtcattaatctattgcgtaaccctgagcatatcatctacctctctttgagtttgcttgtcaataaaatgaagagactttgaaatctgagacttcctggataagtactaaatacagattatgtcactgatgtctgcctctatttatttctcccttttaccctaatctctataagtctacctcagtcatcctgatcctattctacttctctgatgttgttgtcagataggtgtgatcatcctcatcagatcttttctgtattcttagagacagataactttatcaaagaccacagatttattagtatagcatgttaaagtcttctaaagagtctcattgatgctcttttcatctcagtacaatttttaaaactgctgaatgcaaggtactgagctgttggaagtgactgacagatgaatgtaacagattcatagagaaggaaaaaggaagaaaaactcatgctcttcctatagtattgatatcagtgtaagagccaagagaaaggtataaagtatcatgcagatattaagggaaagaaaacattcactttagtaatctttcctcattttctagtttcctcttatgtactatgatttaatactgtagtaaagttttaataaaatatgagctatatgtaattaagtgggaggttgtggggctaggcacgaggctcacacgtgtaaccccagcactttgggaggctgaggcaggcggatcgcttgatctcaggagttcgagaccagcctggacaacaaggtgaaaccccatctctactaaaaacacaaaaattagctgggcatagtggcacacacctgtagtcccagcttcttgggaggctgaggcaggagaatcgcttgaatccaggaggcagaggttgcagttagccgagatcatgccactgcactgcagcctggacatcggagcaagactttgtcttagaaataaataaataaatataaaataaaataaatgggaagttgtgtatataaattataaatgctacattcagaaaagcttttgaaggttgtcagacagtttcttaaaggaagttcaccagttctttattgaacattgaagaaaacatacagtttagactggcattaaaactgaaagaagtggccagacgcagtggtagacgcagtggttcacgcctgtaatcccagcactttgggaggtcaaggtggatggatcacctgaggtcaggagtttgagatcaggctggccgacatggtgaaaccctgtctctactaaaaatacaaaaattagccaggcatggtgatgcgtgcctgtagtcccagctacttgggaggctgaggcaggagaattgcttgaagccgaaggtggaggttgcagtgagccgagattgcgtcattgcactccagccagggcggtaagagtgaggctccgtcttaaaaaaaaaataagtaaataaattaaaaactactgaaagaagtattacaggcaatgggaaatagcttgagtggaagtgcagcagaaggaaaaagctggacaagaatgtagtgtcagagaataggtatggaacgtgtgagtgactgttagaggatcttgaatggggataacagacttgatttcataaatactgagatgtcatgataatacttgaggactaaaccatgttttaaggacagttgtatgcaaagttgtaatcgcaagaggaaaaaatagtggaaaagaaaccagtaataaaacttgccttaatgcaggtatgctaagacaatcaaatgggatttcattaattttttatttgccatttatagccaaagattttgtaaaagttttgagcccagtcaggtgaaatagtctcagaaagaaagaaaagtgaatctgagacttggagacattaatgttgatattttggttttaaacgtgttttaaatccggtaaaagtgagcttctcacatgacaatattcagtgggtacttgggagtatgggttcgaatctaggtaggagatatatcgatattttgggcatcatcaggaaagggagagtagttaagcctttcatataaataatggtgtggcgtttgggcatgggaagtcttggaggaaaggaagaaaaggagagggtgaggactgagataagaatggcaacttgggtttaggaagaagaagaggaatcaatgtagagaacagatagtgctgaaaaatacagcatcttctgtagggattggcagctttttcttgatttttgtcttaatatttctaagagatggaaaaagctactatattctagacatttaacagggttaaaaatgttactaaaagatgatcaatgtggttttcattcaagactataacaatatgtatatatccaaggaaatttaattctgacttaaaaaaattgttttgcttgtatagatttagggacacaagtgtaattttgttacatgcatagagtgtatagtttcaagtcagggcttttaggttgtccatcatctgaataatatacattgtacccattaagtaatttctcatcttctactcaccgtttcaagtctccactatttatcattccattctttacattctgattttcatttactaggtgtattagtctgtttttgcattgctttaaagaaatacctgagactgagtattaaacaggtttaacctgttttctttatgaattcttctttaattggctcatggttctgcacgctgtacagaaagcatagcagcatctgcttctggggaggcctcaggaagcctccaatcatggctgaaggcaaaaggggagcatggtgagaatgggagcaagaaagagaaggagtggtggggagaaggtgccacccacttttaaatgccagctcacttaccaccaagaggatggcccaagccattcatgtgggatctgcccccatgattcaagcttcttccaccaggccccacctctagcactggggattacaattcaacctgagatttgggagggaaagatatccaaactatatcactaggtctggatcttgttatttattttttggaacatagtcatatatatccaaggatatatattgtagaagtccacagaaccatactaatattggacttctgcttagttaggtcttatctatctgaaacatgatattcatattgcagagaagattattttctttagtgattgaggaaatctttactacttatacatttttaatataatactataatatttgaagatgcacattttagatgtagtttaattgaaacctggaaatactattaatttgctttttaaagtcctaaaatcaggattatcagattctgaattaatggagtttaaatcaaaaagattacaaggcagtttttcagttttattctggttaattttatcacagctttggaatcctactttgtttatttgcttcttgaagttagatttcccagtgaaatttcagtatcacataaagtcttatgaaatggctcattgcactttgaactttgagtcaaggaagtgaaatttattgatagattgttggtgtaatatttatcctgtttgtggtagcttttttgaataataagtgtcttagaagaccatgttggagtagcctgcatgcttttatcaaacatattaattatgtgatggctgatactgctttagatattacatagaaatagtagtaggtgtttactaaactggaaatttcatttaacttggtttagctttgccttgttctcagtcacattgataaaaatgtaagacttttgtttatcttttagaataatgacaccttttggtgctgagaattttttgttttatatatatatatatatatacgtaatataaatacaaaatatatttaaatatgtataatatttctcatacactttatgtaactttgtgttcctgtttctctattatcttggcatgttttcttcaaatggcacttcttaacctcctaaggttaataaatttctttgtaatggacttttgttttctaattcctcagcgtatgacaaatgaattatactttgtcaaattatttaggtaactttcagtttttgaagtcctgggatcataacattcatcagtctttaatttctgtcattaaggtcattagctataaatgaatttatgagtagatttaaaaaataaaacatacaatccttcccttaacacactttcccaccatttggttcaactgctagtgtaaaagcatgatgaattttgagaagttatattttaccagttactttattttttaccagttatttaaaacagacatgagccaaagccagaatacttgttaatgaaaatgaggtgttttggaggaaaggaaggttgtgctgcagtttttacttgaaatctgttacatttctttacagaaatttcaaatctcttgtttcctgttatgatggtggcattatatacctttaaaatgtgagctataggaaaatgaatgatggttaattttttaataaatatttagacttgtgtttttgaaattttttataacattgttataggttttatcctctttctcttgtgaacatgtagtgatttgtattttgtgatctttgccgcatgctagagacttaagaatactatagcaaatatctgtcttctttacatttaaaaatttttcgtgactactccctgttgatatctgtcttaaaagttacttttgatgtagttcacaaatgtaccagataattatttcatcgtttttaatgcttaaagtttttatttgtattaggatttttagtatgattttaatgttaaagttttgaagttactctgccactagaagtctaattttgggacttactattcatgaaataggaattgacttttatataagtaataggaccttattttgaaggttcaaactggagaaaatcttacattgtttatatttttatttcatttatttcagttgatttgcttgagatcaagattgcagatacagaatccatatttcgtgtatattgctgatattaatcattaaaatcgtttttgacagtttgacagttaaaggcatttcctgtgaaataatactggtatgtatttaaccatgcagatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggtttgtactttactttcattgggagaaatatccaaaataaggacagattaaaagctatattttattttatgacatgtaaggaactataatttgttttctattagatctgcaggtgttttgcttactctggcattggtgagacattataagggtaaataatcctgtttgaaggaaaaggccttatggcattgtaacatgagaggaatttttcttaacaaggatggttaactgagaagaaattagcatgggaccaatattttaaaaattttggtctataggtagaaatgagatctgttctgtggtcttatgtagtgacacaaaccactttttctccattttggcttatgtttctttttctttccttttttttttttttcctttttgttagagacagggtcttgttctattgcccaggctgagtagctaagactacaagcatgtgccaccacacccagctaattttttttatttttatttttgtagggacagggtctcactatgttgcccaggctggtctcaaactcctgggcacaagcagtcctcacgctttggcatcccaaagagttggaattacaggtgtgcgccatcatgcctggccttaacgtttcttaagacttgattattttctatttagcttctgtggatttactgattaattttttaactaggagagaaatcagtatgaagaggaagtaataaagaatgaaaacatggtatttaaatgtgcaggtttagaaagttaatgaagtttgaatttgattgatctgtatttagagaaggcaacgtcttattattttaaaaccaactatccgccctgtgcggtggctcacgcctgtaattccagcactttgggaggctgaggtgggcagatcagctgaggtcaggagttcgagaccagcctggccaacatggttaaaccccatctctactaaaaatacaaaaaaattagccgggtgtggtggcaggcgcctgttttcccagctactcaggaggcttgaggcaggataattgctgaacccgagaggcggaggttgcagtaagccaagaatgcaccattgtactccagcctgggcaacaagagtgaaactccatctcaaaaaaaaagaaaaaaaaaacaacaactatcttcatttaaaatattaaatgtgaatatttaaagtgagactaaggtgcaacatttttagatagtaatgaagaaaaggactaactttgtagtgttgctgccttgttaaacatactagatagcatattgccaatctttaaacattctcaatgataggatttatttactttttctgatttttagcttttcttttgaaagaaaataagaggaagtttcatttactgcaaaattttaaatgctgctttgatgtatcagtagagatataattttcctttatccagaatccaagtagctggaaaaaaaaatcaaaatatgctgaacttttttttttttagccagaaacccatttcctatcgtctgtacaaataaaagttaaatatatctcaataacttagaaaaattattttttgataatccaggaagtattagcaactgttttaaaattaagataactagtaagttttatttagctttcaaaaataggcatctacatcatcatctctgcatacctttaggaatttcctaattcttatttcccttcatctgtactttaacacatgcaaaattgaaggttagattaaatatttatgatttatttgtttatccttgactacataaatttccattttattgattttccctgccttatttaagaatatgctatgattaaaacacaaaaaattttagtataacccatatatatatagaattcacctttttgttatttaaatattattggcttattttcttctaagtaaaatacaattactggctaaaataattgaaataagcaaaaaaaaaattttaaagaccttgtatacaagattactttgccaggtactgttaaaagatgcaatgacatttaagacgtaacatccttaaggatcttattttctgggggataaaaaactttaagataaattagaataaaagatttaaatggcattttaaggtaccaggtaccagataagatgtcacaaggctgtatatcattaattgccaaatgatttatacaggccagatttctttgttggtcaatagaggtttaaagtgatgaacttctgttgtgtttttttattaagaaggtattatcttattagtaagaagtgattttttttaagaacaagcattttataacatcaaaagaaatcagtagtactctttcctaccccctcatatttattctgaaagtattcaagcattatattgtcatgtaagaaactggagcttctcatgtttgtattgctgtagaagtaaacatgtatttgccatgcgtcatcagggaagttgcactcaccgtccaagaacttttgttaaagtaaatcttggaataggtagctcatttgaaatgtagaaaaaattaaatccatatctgaattttgtttatatgtatgtacacgtaaactaaaaacgtatttaaagctagtattagatgagaaaagaggtttttttacttaaaattttaaggcaaaagtagtttatcttagatcttgtgagattgtatttttggtttaaaatttgagaatttgagtgaagaaaaatcatgtgaatgaaaatgcaacagataactcagattgccttataatagtctttgtgtttacctttattcagaatatcaaatgatagtttattttgttgactttttgcaaatgtttaacataggtgacagattttcttttttaaaaaaataaaacatcattaattaaatatgtcatttcatttctttttcttttctttttttttttttttaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtcagttaaattaaacattttgtgggggttgttgacttgtatgtatgtgatgtgtgtttaattctaggagtacagctgatgaagaacttgcttgacaagtttttaacttatgtattatttcgaagcagtgtttacgtagcagtaacatgaaagtttctaataaaatacccaatgtacacagcgtcaaaaaagctgcatttttccttttcctaattcttcgttgtttgctgaaatctggggcaaaggtgcgggagggggctaaatgactgggatatgaagtaggaatgggagaggaaagaaatagatgggaactcagtcatttgggaatgattcatatggaatgtttttactgcttccactcctgtctgccttccaatttattctcaatccctcagagtgatcttaaaaatagacttgattgtgtcacttctgtttacactttataaggaccttgtgtttttttttttaccatgacctacaaggcccagcataatttagcacagggctacctcctacatcagcactagtcaccttctctccttgtttcttgagattcagtcatactggtctttcttcagttcttcaaaatgctaagcttctgcctcttctagtctttccagttattttccttctccctgtaccttttcatctcagccttttcccctgaccttccatagctatcttcatatttccagccttagcttcaatctcatattctctgaagtcctttgattgtcctcccgttattctttttttaaaaatcctatttccttatattgtatcttagaattatttggtttgtttcatttttgcctatgtgtgatatatgtatttctacataggtatatatatctacttatagacaagaattcttcagattaaaaaaatctgatttgtaaacattcccaagtggttgtttaccatttttttcttcccccttcctatttcttattctacctgattttcccctgttcattcaccacactcgtttctttctcttttttactctctcttaatttttcattcaatttttataacatgtaataaatctaactgtagcgtctgagtattaagaatattgctagtaatacttcacctgtaatcccagcactttgggaggctaaggcaggcggatcacttgaggcccaggagtttaagaccagccggccaatatggcgaaaccctatctgcactacaaatacaaaaattagctgggcatggtgtcgcacacctgtaatcccagctacttgggaggctgaggcacaagaattgcttgagcctgtgagatggaggttgcagtgagccgagatcacaccagtgcacgtgcacttcagcctgggcaacagagcaagactctgtcttaaaaaaaaaaaaaaaaaaaaaatatatacacacacacacacacacacacacacacacacacactattactaccaatatacatacatatatgtatgtatgtatgtatgtatattggtagtaatagtaatacttgggcccctgcacgttttaagtgaaaatagatctaatattaaatgtctttagcccttaaattttttttaagtgttcagaagtttccctttaaaaaaatttttaatatataataattgtacatatttatgggatacagagtgatattttcatgtatgcagtgtgtgatgatcaaatcaggataattagcatatggatcacctcaaacatttgtcatttctttgtgttaggaacattcaaaattctgtcttctagctatttgaaaatatacagtaaattattgttgactagttacagttctatagaacactataatttattcctcctgtgtgtaattttttatcttttaaccaacatctccctatcctcccctcccactccctttcccggcctctaataaccacactcttatgagctcaacttttttagcttccatatatgagtgagaacatacggtatttatctttctgtacctgacttattttacttaacatcatgtcctccgggctagacattctctttagaatccacaggtttcctttcttttctctaaatctgcattttgctcagccattaacttttaaaatgtctttttccctttagttttattgttttctattttaatattgcaagatgttttatatttgtgattacaaataaaaactccattattagtaaacaaatacaatgtcatatagtagtaagtgctataaaaaatagacaggatagaaagtaatcttggtttgtatgttttttgttttttagcaaagatgattagagaaggcccaaccaagcagataacatttaagcagaggcctaaatcatataagtgagttatacaaatatctgggaaaagagttaagagtacagatgcaaaagcccttagacaagagaatgagcttggtatatctgaagagtggataagtcattttgactgaaacagagtggacaagaaaaccagtccaagtgtaaagacactagtgtgtgttcagcataggaaggatgtaatctgaattttgtgtttaatattccctgtgttcatgctttcaaaatacagatgagtgaggaaagtagggagaaggggtaataaaggaagctgagagatcagttaagaggtacttgaatagtttagtaaagatgagagaagatgtttgcttcttgttgcccctcactgcttagaatagtggcagtgaagggtaacaagaagctgtcagattaacttaaagagtttactgatgcagtggatgttggttgtaagagaagaattgataatgactcttggataataggggagggaggggctgtcaatataatataatgaagaagggatttgaagtcatttctgatttaaatctcacatccactacctacttttaatagatatgtagcctttaacaagttccctaacctttctgggccttagctacctccccttggaaatggaaatacctaacatgtaaggttgttttgacagttattttcactaggcatgtaaaggcacttgactctctgttatagaccactgtattatgttaatgtccctctccttcctccctttaggtaaagtttttagggctaataaatcccaaatatcaatgttgatcagtagtttgtgtttgtgtagtgttgtttatatcaaaaactacattgaagccgggcacagtggttcacgcctaaaatcgcaacactttgggaggccaaggtgggcctcccaccttgaactaaggagtttgagaccagcctgggcaacatggtgaaatcccatctctacaaaaaatataaaagctagctgggtgtggtggcatgcacctgtagtcctagctacttgggaggctgaggttgatcctgggagtttgagcctgcagtgagctgtgaagatgccactgcactctagtctgggtgacagagcaagaccctgtctcaaaaacacacacacacacacacacacacacaaagaaatacattgatttttcacataggtagtaagagaaacattctttttgaactcagctgtttgtgaattgaattttgtaattcaaatgctatattatgtaaactattgatgactttcaatctgcatttattttgtataattatttagttaatatttgccacttatattccttaaaaaataaaattgaggttgggcgtggtggctcacacttgtaatcccagcactttgggaggctgaggcaggcagattgcctgagctcaggagtttgagatcagcctgggcaacatcatgaaccccatttctactaaaatacaaaaaattatctgggcatggtggtgtacacctgtagccctagctgtttgggaggctaaggcacgagaattgcttgaacccgggaggcagaggttgcagtgagccaagatcatgccactgcactccagcttggcaacagagcaagactcttgtctccagaaataaaaataaataaattgtattaacatcctgatagtttatctgtttagtacctagcaagaaagaaaatgttgaacatcttaagaagagggtcatttaaaaggcctcttaaagatcatgtttgttacagtgcttaaaaattaatatgttcatctgcaaaatggaataaaaaatctgttaaaaatatatttcactaaatagtttaagatgagtcatatttgtgggttttcattttaaattttctttctctaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 193386 - DNA, 1675 bp, homo sapiens
gttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatgggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcgtttcagtgggacccgcagcagccgcggctggccatctgcacgggaggcagcaggctctacctgtggtccccagcgggctgcatgtcggtgcaggtgcctggggaaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttaaaaaaaaaaaaaaaaaaa

SEQ ID NO: 193387 - DNA, 518 bp, homo sapiens
gcaagagggctgccaacgctactaatcagacatgctgggtccacagggctgtccccaaactggaaagaagtcctagaaaatagatgattcttcctaaaacgtaaattggatcatgcctctcccccaacagtctcatgcctatggaagggaatcctgtcccccaaggggttctccctcctgtctcctccaagaaccaggcagtgtggggtggggcagcaggacccagggtctcggagctggggcctccccagcctcacttggggcctccaaggctaagttctgtgacctccagggcccaagagtgagttcctctggctgctccagaaagtgaagagagaagagccaaccccggctcgggccacgagccccgaggcactgaccacagccagagcaggcctgctggaagctccgtccctgctgcagatccctgcgccacatgatatcagcaattgctgcaatttcgccctaagtactcttgtttcccctaataatccacgtttcatctccacaataaacat

SEQ ID NO: 193388 - DNA, 759 bp, homo sapiens
  misc_feature (457)..(457): n is a, c, g, t or u
cactacagggaacggcccaggaacccatccacccgtccccagctctcatcactctgacctctggctttttgtttcctggggcatttcacagcaaattccacctatgagaccgtctcatccgtaatacaccagtacatgcttccagcagcttggtgacatgaaaggacctccgtggctggccttactccctgtggatgccacagctgcaggatcctggggccccaacagaagccggtgaaggaagagttcctgctccagcagaacaaaactgccctttgcccagaaatcctgcaaactgaggctggacgacttgaaatactcatcagcgagattaccacgaagcccaggtgcgagggaccctcacgcctgttgctgcgtgggccgcccagacatcgccagagaccaaaccgcagaagatgctcggagcccaacatctacaaacctgccccgccacggnccccaggctcagaaactggtttttagtcagctccaatgattagcttttttttttttctctttggttcccatagaaatgcctcttcaaagcattatgggacaacacacccacccagtttctgtaccggtggagcttctgggggaagtttcaggactaggaacacacagggcggctcaggacacattcaccccaaagtatgactgtggagaccagaatacgccacccctaaatatgactataggagaccagaatacgtaccccaaaatatgcctgtggagaccagaatagccacccaaatatcc

SEQ ID NO: 193389 - DNA, 25892 bp, Mus musculus
gtacttccggccgctgcctggggcggttgcgggaggtacttcggagccgggctggcccgggctggccgtggccatgaacttctcggagtcattcaagctctcgggcctgctctgcaggttctccccggacggcaagtacctggtgagctgcggcgcgctgggcggaacctaagtgtgggcgcgcgacttgtgcacggggccggggcgggccgaaggggggcgggaagggggcccgagccgggcggccgcggggactcaggctggacttagggggcggggtgggaggtgggagagggaggcaggcagaggggtttcagcccagatgagggagaaccagatgattagagagaacgaacctgaagccgaagagggatccaggccagccaggctgggggatcctggcaggtgaccagggtggagaaagaggacgtggagcagagtggggatggagttggggttgctattctggcaggtggtcagggttaggaaggaggtcttggagcaggtggccagggctgggtgggtgccaggctcccggctccagtttcccttcatcaaagttggataagatgactctgctttcacacatttgagggcacaggggatggcagctcattgctattttgtatgttttctgtgagcgagctggttaaacggggccctcctttgtgaaactcgtcataagcaaatggtttaaataactagctttcattgccagggttggatgttagctgtctattctttgggtggcagaatagtgttcagatgggtgtttcaaggtacgccaacatgaccattgtgcatttgtagaaggctgacgttaggaagccatcagggaaaactcaagtcttattttaaaaaactgtggttccgtgccagtcgggtagcttggctagtaacggtacctgccaccaaacctgatgacctgagtcccagctctaggacccacttaatggaaggagagaactgtctcctgcatgttgtcctctggcctccacataagccgtaactagtgcctgacccttctcacatacaaatgcaatcctaatttttaacaagttttctttgattaatctatcattctctttttaactgactgataccattgattgattgattgactgattgacagggtttctctgtagctctgaccaggttggccttgaactcaaagatctgccccttgtctcctgagtgctgggattaacggagcatgccaccatgcctggctgtcttgattctcagttcacacccctgctgtgtttgtccaggcttttgagacatcctttaccctccttatacacatcatcctaacaatgtaggaagtgtcagggtaggacctgcttagcagggaaaggtactgccatgcaagcccgaggacttgagctccggctcgggaacccacgtaaaggtgggaggagaccatcagcctcgcacacattgatacattttacctttttccaagtgcctccagagactaaggttgctttacggttctgaaagtctcagtgaacagcaaagaagttgcatttgggttagctgatatttgtgcttgccgctcatcaaaatatcgtggagctcttaataattgtttctttcaagttttgtcctaaatcctgagcagagcgagtccatgtttccagtgttggtgtcttaagtgattcctaaggaatccattgtaacaggttactgctcaccaaactctaatgtgagaacacaagccctttgataggtcctccttctgatctgcacttgccctcttgctctctttccacagaagacaaatgtggcttcattaaaaaaaaaagagtctgtgtgtgtgtgtgtgtgtgtgtgagtgagagagagagagagacagagacagagacagagagacagagatagaaacagagagatgctacaacacacgtgtagagggcagaggacaacccccagtgttattccttaccttccaccttgtttgagacaaggtctcttgctcttcactgcataaagcaggctagctggcccacatgtacctgcctcagcctcccctctgcctcccctctgcctcctcatagaaactaggattttaaacagtttttaggattaacacagttttatgtggcttctgtgcatccaaacctgtttctgaggcaagtgcaagtttttggcttttagacaatggcataatatgcaaagctggcctcagactcagaaagtagttgagcacctccctagtacagtgattacaagtgtgcaccatcactcccaagtagtaaaaaaatacacacacacacacacacacacacacacacacaggctttttgagacagtttctctgtgtagccccagctgtcctggaactcactcagtagagggaggctggcctcaaactcagggatctgcccacctctgacttctgagtgctgggattaaaggagtgcaccacccccatctttaaatttacttgtacagatggctcagcgggtaagagcactgactgctcacccaaaggtcctgagttcaaatccccgcaaccacttggtggctcacaaccacccgtaatgagatctgatgccctcttctggtgcatctgaagacagctacagtgtacttactatataataataaataaatctttaaaaaaatttacttgtacaaatttgtgggttagagtatgataatttggttaatatatactgtgtggaacttttaaacttttgaatgctccaccttttatctttttctaactcattttgcaatgagacccataagttttggtccacatgaagctaagtgtgtcgaacaggaggggaggagctggccattgaggcaaggctccctgctgtagaagagatgctatcccgtgctgtctgcctcactttttaggcttcctgtgtccagtaccgattagtgatccgggatgtgacgacccttcagatccttcagttgtacacatgcctggaccagatccagcacatagagtggtctgcagactccctcttcatcctgtgtgccatgtacaggcgggggcttgtgcaggtttgtaccaccatgtattagtagagtgtatagatgggtgctacatgtctgtgggccttgaacaggcatgtgccacttacatatatgatgtgtgtaggcaggcacatgccacatatacataagactcacataagtgtgtctcatgtgtaactaactggtctggcgctgtttctgtagcagagttagaattaggaaacgtttccaggagtgtgactaggaaggagtccaggtgtttgcacccttctttcaggtttagggggaaatgcaatgagactcaaggttgccttcttttcttatgtgtaatttatttattttatgtgcattggtgttttatctgtatgcatttctgtgtgatggtgtcaggtctcagagttaccgatagctgtgagctgcagtacgggggctgggaattgaacggggtcatcaggaagagcagtcagtgctctcggctgctgaggcatctctccagcccccagatatgctttcttttaaaatgtaatgctctctaatagtttaatccaaacacttttgatgtggaaaaacaaacaaacaccaccaaaacagtaaattgttctcagtctttgagcatgatttttcttttttttttttttttaaagatttatttattggttatatgtaagtacactgtagctgtcttcagacactccagaagagggcgtcagatctcgttacagatggttgtgagccaccatgtggttgctgggatttgaactccggaccttcagaagaacagttgggtgctcttacccactgagccatctcaccagccccgagcatgatttttctgagcgggaggtatttgcaatggcagtggaacaacttggacagggttctaggaagttctagaaggttctagaaggccgtgttccagtattcactaagcctaactaatgaggtcacagggatgggcacatgagcagacccttcaaaggtgcactgcagtgaagtcaccaggaagtgtggcttgtagccactgggccatctgaggtagcatggtgtatatcctctccctcagagaggcctcctgcgtggtacagctatttgcactcctctgtgtttcttttatgaatcaaggtctggtcactcgagcagccagaatggcactgcaagatcgacgagggctctgcggggctggtcgcttcctgctggagtccagatggccgccacatcctgaacacaaccgaatttcatgtaagctggccaaacgtagcccactctgttcttcgcctaaaatagcctgggaatgtgaaagtctggttctggagcagtattcaggccagagttcataaacagtataatttttaaactctattttaaagaaaaataggacattaaaaggagttggcaagatggctcagtgggtatggctcttgctaccaagccttgccacatggtggagggtaagaacgacagatgccccaaagttagagtaacaagggaaaatgtatgtcttctgtaatgggctgttacaggctgcagtgctcatgctgacatcttaaagggacaggtgctcatgttgacatcttaaagggacaggtgctcatgttgacatcttaaagggacaggtgctcatgttgacatcttaaagggacatttggcctgggcttttggctgcatatttgagtgttttctagaccactttggccagcaatcttcatgcttatggagttctgcagaccagagtccagcttccagatctcatagacttgggctcagtccctccgttaatggcccaaaggaaaggttacccactgcagaatttataaactgttttttaatgtacttttttattcagcagctgtgttacactcactgaaatggaaaggaacatttggacagagagtagactgtacagactgcctctgtacactgttaacctactgctaggtcatagccactgtgcctgtgacattaaagtgaatggcaacatcctgtgtggaggaatatgtcacagcaaggggaccctgaaaaatataccctccctttttgttgtattgagatgggatctcactgtgtagccttgactggcctggaacgcactatgtagactaggcttgcctcaaactcagagagctgcctgcctctgcttcttgactactgggagtaaagtagccaccagtcctatcttattccaagcctttagattttagcttctaaaagtcccacagacttcatttaccaccagctatgctcagtagtcaggaggtgaccctgtgcgcatgacagattcgtagagtggacacataactgagagtcatatgttcccgctcacaacagttagatcgctgtgtactcttctgggggcaggaagtccacgtgagggtgctgcaagatggagagaggcccagctcccatgagacaaggggaagacgattgaattgtgtggctggtgtctgtctggtccgtggaagacactcccctgcacacgcacacttcccagagcacctccaggccttgagaggctgccagcctccagagggcacctttgactgcattgcacaaaagccattttcaccttttttggagagtcttggggtccccgatgcatatgacactgtgcggtttacagcagctcacaggttacattgcctgtacaagggccctcctagccggcatagctgctgctcttgttccttgtgaggaaaggctctctggggcacactcacctgccgtctgctgctgggcatgagttgtgaggcaccagtggctttggcctttcttatgcacctcttctagtgtctggatccttccaggctagtgcaggtgggtgtgtgcgcagcttccaggctagtgcaggtgggtgtgtgcgcagcttccaggctagtgcaggtgggtatgcgcagcttcccgagggtttgcatcaggatttgaagtggcgagacgttgcagcatcgtggggcttttgaaaatctcagttactctccactttatattttgaggcaatgtctcttacttgaacccagagctccccagttctgcagttcagctagcttcctgtccctggggtcatagacaggtcaccgcacaccctggggtgtgcaggagtgctggggttccagactcacttgagcagtaaggcttccccggagatttccccagccccacactgtgtgtgtgggctcagttgtcacctggcgaatggagacatttgctctcatggctgctctgtgtgggtgcactgaagtaaactgcacatgagtgtgcggtgtgggtccatgtttatgtattccagctttaagactctttgtgaagatgggaagcatcctaacccttctctcccctttccctggcagctgcgaatcacggtctggtccctgtgcaccaaatctgtatcttacatcaagtatcccaaggcctgccagcagggtgagtctgtctttacacagtccttgtaactgttctgagagtgtgcacttagagcagatagaggagctacagcagcacctctccccccagcctccatcactgtgcacccctcccccagcctccatcactgtgcacccctcccccagcctccatcactgtgcacccctcccccagcttccatcactgtgcaccccctccccccagcctctatcactgtgcacctctcccccagcctccatcactgtgcacccctcccccagcctccatcactgtgtacccctccccccagcctccatcactgtgcacccctcccccagcctccatcactgtgcacacctcccccagcctccatcactgtgcacacctcccccagcctccatcactgtgcacccccttcccccagcctctatcactgtgtaccccctctcccagcctccatcactgtgcaccccctcccccagcctccatcactgtgtacccccccagcctccatcactgtgcaccccctccccccaagcctccatcactgtgcaccccctcccccaaagcctccatcactgtgcaccccctcccccaaagcctccatcactgtgcaccccctcccccagtctccatcactgtgtacccctcccccaaagcctccatcactgtgcaccccctccccccaagcctccatcactgtgtacccctcccccaaagcctccatcactgtgccatcctctgtgctccttcctgtgtgtctgtgagattccctccatgccatttctttgacaacaggatgctgtaaaaagtagacaggcattgtcctgggaggagaacctttaccttcattcacacagggcactcagcttgcctttggtgcctagctgtcagcttcacttcactaactttttttagtcaagatttatttttaggatgtgtgtgtgtgtgtgtatgtgtgtgtgtgtgtataagagagagagagaggtgtatctgtgtgtgtatgtgcatgcatatgtgtgtctgtgtgcatgtatgtgtgtgagagagagggagagggagaggaagagatgtgtatctgtgtgtgtctatgtgtctgtatgcatgtgtgtgtgtgtataggtgtaggtataggtgtgtatgtctgtctgcgtgcatgtgtgtgtgtatgtgtgtgtgtgtgtgtgcgtgtggtgtatgggtaatgtgaatgcaagttgaagttacaggtgatagtgagctgcttgttctgggttctgggatcagttttcaggaaaagcagcactttttaaaaaagatttatttatattatacataagtacactgtagctgttttcagacatgccagaagagggcgtcagatctcattacaggtggttgggagccaccatctggttgctgggatttgaactcaggacctcagtgcccctacctgctgagccctcgccagcccacagcacaagtctttatccagtgagccatctccagctcagctcactagctcttctgtcgggatggcatgctgtctgtcacctctgagcatctcagaacagggaaaggaggaaggctgggccgagtgcatggggtgacgggtggtcatgccacccacctgccccaaacccagaaactaacagtagagggcacacagtaggggcacacagaggggcacgaagtaggggcacacataggcatgctcttgtttgtttgttgccacaaggacaatatgtctaatgttgcagatcacattagactgatggcatcgtaagtctgttgtgggttttgtgtcttaagtgctactggatctaaagaacagtctggccctgggtgcaggtggtcctcaagtctgttatctgaagtgttcttgtcattcttgaggccttgaccgcaggccttttacagtaatgcagggctggaaaaaagttacttaatgtttttaagtaagattgtcccgaatattctttacaactttagttatttgaaatgacaagttcaaaaggtgactcagcatctttcagaggactctaggtcactgcccagcacccaggtcaggaggctcacaactgcctgtagcttcagctccgacggaatgggactcttccgtcctcggcgcgcacccctgcaggctgtgtgtatacctatacacagatgtacacacatccatacactaattaaaaataaaagcgaaaacgaaatgcagtgacacagctgactcagtgtataaagtgcttgtggagcatgagaacgggagttcaaatctccagacctacaataaaggccaggtacagaggcagaagtctgtgatcccagcacccccacatcaagatgggaggtggaaactaagaattccagaagcttgcaggccagctagactggcatgtgcagttgcaaacaaaagatctgtctcaaacaaggtggatgagcaatatagacgcccaaggttgtcctcttagccctcatacatacatatgcatggcacatgtgcctaaattcacacacatggaccaccaccaccacacacacacaactgcaagctgggttttgaccatcaggtatgcctgtagttccctttgtgaaacatggccctctgctgtgtttcacaaagtgacatttgtgactctttaagaatcaggtccttgggtttgattctgtataatcacccgcctcacctgcaagagggataagggctctgcttgtcagagtcctacgtgacaatgtcttgctcatgggaagatgagaaggacacatttccggggcggggcggggagagctcgctccccccttgtcccttttaaaaagtccctgatgtgctccagtcctttcccacacttggttccatctggttccagtttaccatctctctccacaggactaactttcaccagggatggccgctacctggccttagcagagaggcgggactgcagggactatgtcagcatctttgtgtgcagtgactggcagctcctccgggtaaggccatcctctgctgctggctgggaaaaggggtagaactagcgttcctggtgatcccagaggctgttgcagcccctggggtagacagaatgatggggttcccatggccagaggacaggggccctgtgtgtgactccaagcagtgcacactacgtgtgatctagactccctggtgcatgcacacttggtgcacagtagaagttagcatgttgacatgaactttgaaccctctttctccataagggaattcctccctgggaggaatgcagttttgttggcctgggtaaaatgtctcaggagccgtgacactgagcaaatgctctctgtgcccacaagcttcagtgtcagagtgttagagagacatctgaaggggcgccctgggaagcagggtgcgggtgggcaggggtccatggggatgagggcatgcggccttgcccagcatggttggcacactgtgtgcactcaccagaacaacacacagatactttgtctgttgctgcatataaaatgatacatgaaccaaaagcattagttagaaaataaatgcactacttgtctaaggacatgttttccaactgtcatgttttttttctcatctggaagcactttgacacagacacccaggatctcacagggatcgagtgggccccgaatggctgtgtactggccgcgtgggacacctgcttggaggtatagcacatgaccagcagcacagtccctttcaggaatgttcacctgcaggtacctgtgtgctcagtgcatcgagctgctgggtgctggcgtgccgcacgcagggcctgtgactgtgtcaatgtctcatctgcagtacaaggttctgctgtactccttggacggccgcctgctgtcagcatactgtgcctatgaatggtccctgggcatcaagtctgtggcttggagccccagcagtcagttcctggccattgggagctacgatggaaaggtaggaagtggctcagggctcaggccaactcgacgagctgtaggacacctgcagcccgtgagctacctgcatgtcattctcacggttccttccccaggtgcgcctcctaaatcacgtgacctggaagatgataactgagtttgggcatcctgcaaccattaacaaccccaagacagtaagtctgcatacgcttccacccgagcaccgtggtctcccgggtgcagggagccgcccttgaccctccttagttgctgtgatgttgtcttccctgttctgcccctcatgccctccttggtgaagggcatttggagtccaggctcgtccgtggactgatcctgtcctagccggatgctcatcatgctctgccctcggcagatccctgggagagtgagctgaggaatcctgagcgtgggccatcctgccagagcagggcacaccgcaggcagagaggccgggagagctggtctgtatggactgcagctagggcggcccaggcccaggcccaggggtgcagagttgaaggcaggttctgaagctcagaggtgctgagtccgctgtcttctgtcagtgctgaagctcagtagtgctgagtcctctgtcttctgtcagtgctgaagctcagtagtgctgagtcctctgtcttctgtcagtgctgaagctcagtagtgctgagtcctctgtcttctgtcagtgctgaagctcaggagtgctgagtcctctgtcttctgtcagtgctgaagctcagtagtgctgagtcctctgtcttctgtcagtgctgaagctcagtagtgctgagtcctctgtcttctgtcagtgctgaagctcaggagtgctgagtcctctgtcttctgtcagtgctgaagctcaggagtgctgagtcctctgtcttctgtcagtgctgaagctcagtagtgctgagtcctctgtcttctgtcagtggtctggaccaaggacaggtttctgcttcccttggacaaggagggccagggccatggcccggggctcagttagctgccccaaagcctatgtctgcagaaccctgtaggaaggagaagctaggtggaggctgggctttagtcagggtgctcctcctgtaacagtggttgaaccttagagatgacagagtacaggctggccgtgcaggctgccaaggtttgcctgtggttcaagcgcctgtctcccccacgtgtgcactggtggtttctctgcctgggactgcggagtaccccactaacctaagcgtgtgagtgaactttgtgtcaccgggtcagaggacccggggacacgatcaacctagttaaagtagaacgggttcattttggctcctaatttctgaggtttcagtccatggtcccttcaccatttactttgggtagcacattgtggtggggacaaatggcagagcagagctgaccttcagctgctctggccaagaagcagagaggaaggacaggtgaggtcccaatgtggccttcaaagtcatgctcccagtggcccgggcctgtaaggtccatgctagcaccaagtctgtcaggcctggccgtttgctactccacaggctcgctgccaccactgtcctctcctggcctacttttctcctgtgcacacacaggccactgccgaatcgctgtgacatagctcaccatgtaaacatagccatgtgctcagagccctctctaaaggacagcctggccagcagtactgcggtggcagctgcaaagggtcagacttggccgccgcctcttcccagcgacctccgtgtggggcacatagataggttgggccaccttccactggctctcgtcacagactgctagcagccacatcattgtttttcaggttgtgtataaggaagctgagaagagcccactgctggggttgggccacctgtccttcccgccgccccgagcaatggctggtgccctctctacctcagagagcaaatgtaagcagcagagggctgtgtcctccatgggagaaagcttgttttttctctcttaaatgagaatcctctgtccacgtgaatctcagaggctgcttgttttgggtgtggaagatgttaagatgggggtctcaatcctgcagtgtagagaccgcaggtgttctcctgtgaagcctgcctttcctccctgctctgcagtccctgaaggagtgaggggacatcagctgtgcagcacccgcttggagggggggaggcagccaggctgtaggttgctcatgctggcttgtgcttacttattttctgttgggtgatagttctttgattcccagctggaaaggggtagccacctgtgccccgagacgctggaaatgggtggacagaactgccaggtgtccaagtagtggggactagctcagaaagcagggcttcagagcagggctgtatcctgcactggaactgttgtccccagggaacctgtgaacgtgcctctcaccacagctgtcctcttaatccctcctgtgcttctctgcagtgtgtttccttccctctctttgccctctccccttaaccagtgcccttagcccgtcccccgtcgtgttgcagatgagatcgcctcgggaccagtttccttgcagactctgaagccagtagctgacagagcgaacccgaggatgggtgtagggatgctggctttcagctctgacagctacttcctggcatcaagaaatggtcagtgccacactcatttcgtaggcagggtcagctgctcgcggccctttgaggcggagagtagagatgaaccgagaagcaaaggggcagctgtgtgctcctctccctggttcctgcagaaatgggcgttcagcacagcagctcctttctgcacagcagctccttgcccatggcctggccgcctggctgctccctcctgcactcctcactgtgcaagaacagggcttacctctagttttgtttgcattttttggggggggtgcctctgtgtttttaatagtttatctcctttatatactttgtatcttgaccacagcctccctccttcctcgcctcccagtcccacccatacaaatccttccccattgccctgtcccctcctcctcagaggaggcgccctccccccacccccaccctggggcaggactaagcacacttctcccactgaggcccaactcggcagtccaggtaggggaaagggatccaggggcaggggctggacctaggcctccacactgtaggaaatgtacagttggtcttcttgtgggctccctaacaagtgaagtggggggctgtcttgtttgcattttgtacatctacagatgtaaaaaccacaggaagaagaggtgtggctttggcaggccatgtctttgttctgggtgctggtccctgagaacagccagagggctggcagtgccagcactgacatgtgtcccgtctctgcttccttgcagacaatgtccccaatgctgtctggatctgggacattcaaaagctgaagctgtttgtggtactagagcatatgtctccagtgcgctcatttcagtgggacccacagcagccgaggctggccatctgcacaggaggaagcaaggtgtacctgtggtccccagcaggctgcgtgtcggtgcaggtgcctggggaaggtaagcgtaagccagcacatgctggcctcagacaggctgacctgcttaaacctattgccacgtgtcatgcatgggaaagatgcccttctgcatcctgtaggaccttgcccagattgtgtgcctcacaggaactggctgtccttaaggtttactggctttgtcttcagccctggggtgaccagactcctcactcacccgcaggccccggtctctaaccctctggctgcctgtctctctaggtgactttccagtgctcggactgtgctggcacttaagtggggattccttggccctccttagtaaggaccacttctgtctctgcttcctggagaccaaggagagggttggcacagcctacgaacagcgggacggcatgcctaggacctgagtggaaaccaaggcagtagactgctgattccaacgtgagctaacggctgcacaggttctccagatgggatgggctattctgcccagttttctgtaaatatgtataaagttatgtaaagtaggtatttgctaatccattgaacagtggtggttgttttcttcaaggccttagctcacagacccaaggtcttgggaggataaagaatcctgaagtaaggactcaagcctgcctcatggccttgcagactctgaagccagtagcgaacccgaggatgggtgtagggatgctggctttcagctctaacagctacttcctggcatcaagaaatggtcagtgccacactcattcgtaggcagggtcagcattccctgaggggttttctgtcagtgggctttggaacaaggtggactaatgtcagactggccagccctcctgcagctggatgtactcagaagtgccccgcacctgtgcctgtccccgtgtgagctgtaaatcccacaacagttgggcaggtctctggccttacaagtgaattctgcagagaggcctgggtcactgcctggtagagtggaagagctcagcccacccaaacctctctatctctagtaagtgccttgaaagcagacagaccagtatgtctgtactggtgaccagggttcccaccaggactgcacacttgtgtatctgagtttctgtaaagaggaccatgctcacaagggtcctcagtcagccagacttcagtcctcaagacagtctttggcactcctgattctgtgacaataacttcaaaaaggagcaactccatttggtttaaatgtctttactagaacaaaagcacaggctgaaaacaggtgcatctgaggtcacctttcctcttggataggccatggcattccggtcacatccatgccggttaactaaagcgagaggtatagagtgacaggccagcatctacagtgcactggcaaggctagaacgacagcagcaagctgtgtgtggctggcgtgtcaaagctcagcagtgctcagtgagctctaggatgctcgtctgtttatagcatgcacttttaaaacccaactattcagtcccttttaaacagagacaggatgatagaaacccaccaccatgacttccggaaggggctagcttatgttatgagagtaaccttttgggcctaggaaaactgctgtattaacacaacctggattaatttataaagtgtgattctaagtcagacacattcacagaaaggcaggttcaccaggagctgccaggcagactgtctttcttagtgactggctgctggctgctactgtatttagcttttttaaaaaacgggctgaattttaaaatacagcacttgagagttaatatatagggagagttaaatatgtgcagaagccgctcactgtactcagctgtatgcaacagtctacacagcacaagtgggtggacattgtgctcggcatgctggagggagaacgtggcgttacagaaggaacacagtggtatgggggcagctgaatctgcctttgtaagattgtgttgccaagatgtccaatatccaactaaatatacataatccacttgactattctaatcggatacatgccctccttccctccagccagtgggtggcatgaggtggcacagggagtccccaccaccttggtttccgggacgcagctgtctagaagcctatcttgcccctggtcatggagtagcccagcttggcttcattgttgatgaaggacatgagccccacgtaggtctcgatgaggagggggcgctccagcaccagcacggtattcgcctgccctggcagtgggctctccttctgggccttcttgacagcttggatcaggagagccttgaagctttccaactttgaagagaataaacatggagccttaacctcatgccaagacagcagtactgggaaacgaggattctgagttcaaatcctcccaaataccacatagtgatgacatcaccaatgacaggttgggccctatgagctgtgtcatcaggtggttcatcatgtacaaacatcatgaagggacctgccttaagtccaacctagagagtaccagtctatctctaaagatgcagtcaggagattcggcagcctgagacaaggtactgccagtgccaacaggtggaaaatcttttttacagacgcacatgctctggagtgcacctcactaagcaggtgatgctgtaattgcacacgctgcctgcactggtgtgctgtgcactgactgacaggtagcatcacagatggaggaattcatgaggactatgatgtcaccaagtgacagggctttctcagccctactctaactgtgcagaatgctcagcgctccctcagcacctctcctgggaacttccagagtacctgtgtcaccagcagcacctgccaagccccgccagtactgtgggcttttcccatgctcgctcacccacccagtccagactgagcatcctgcaatgggatggtgactctgttcttaaacagcaccacctagcttcctactgtggaactgcacctccagggttcacactgacagtggccttggcctgcttacatggcacagagacgctgtcttctcgtccatgccagccattgggtgttctatgaaggtggcatagggcatgtttgtagaccaggggttccatctgttgatgaaggaagggcggctctgcttgtcccactgaatgcgaaccccaaagccttctctcctgatgggggagggggagaaagccttgcttaccacaggaatacaacattgcattcagtatcagggatggctggggaacctgtgacctagtgtaacaatggcctccactaacagcttcacacacttccaaagcgtaacaagttaatgagcctcctttgcagcctatgaaaccggcacacagtccaacctggcctaattatggccgtgtttgttcttaatgttactgaatgatgcttaagttagtagccattagcttcctggagtccctagtcaaataattcttttatagcaagccaaccagtctctgaaggctgttaggtgttttgcgatgtatcgaatttttagtaatactgagcacatgccctgtgtctccctcctgctggagttaaaactcccagactccctacatagcttatgacagtgggctctgattccatgtatcttaacggtatttaaatgaatggtttttagtggggacagagtggccgactgtgccagcatccctttcaaggaggtactgagcaacccggaaatcaccagcctctacttaaaggtcctttccactggttcttcaagatgagacctttacctcacaagagagtgggtcaataccacttacaggatccgctggggccctgccgtgtagtgcgctggtgcacctacttgttgagcgacttcggaggaaactggaattctccacaggagatggtgtctaccgcgctgagcgccaccctgaccacctgctggcactgaaggctgatgaagtcatatttgcagatgagcagcgactggtcggtgaccagcaccagccgctccttctcgttgttccagtggtccaccctggagaggagaggggccgcccatcaccaagagccccgcctgcccccgcccgcccccgcccagtgtccccgcagtcccctcgcgccggcttactcggtcagcagccacaccccctggatctcgccgtcctccacgggccgtaccacggcgcggatctcctcgaccgcctgctcgatggtgccgggccggaacacgaagtactccttgacgcgggcgcggcgtgtagggtcgtggacgttcagcggccacaacgtctggcgcagcggtgtgcccgccccaggccggcccgcacccgcgtcctcgccggccgccagcaccgccgtggggctcgtgcccgccgagtccaccgtgtcccgcagctgcagcatcgcgccgccaccggcagcctccaccgacggccgccgccccggcgtccgcccggccgcgccccgccctccctcgttcgccttgtgattggttgagtcctgcagagcccgccttccggacccgcctccagctccgtcgactgcgtctcgcgattggctttcccctaagctgtcttctgcaattgggtctaaagtgctgccgttcatgattacggcggcccctcctgggccggaagctgccgccacgcgcggagccacttcctgtttacaggaagggcgagttaaaaaaaaaaaaaatgccggtcgggggttcctggctgagaacggggaaagggacgccatggactcgcgcggaagggggcacttgggggctcgtgcgtagggcgttgccccgacagtgtgtcctcgcttggctccgtgcccttcaccttcgggcttacggtgcacttcgggcggaggtgtgcggcgcacttaggaggtgtgcatgcctggggagtgtgaaagtgtgggcatgggtgtgtgcgcgtctgaggattgtgaaagcgtgggaatgggtgtgtgcgcgtctgaggattgtggacactgtgtcggggcacctcagatagaggcttctcaggagtgtgctgcactccttgggcgtggtcaccttgggagtgtgggtttatagggtgtgtgcacactggagataggagtgtgtgcaggtcagaggtggctgtcagagggttctttatattgggcatgatacgcacaagtaagctaccatgtcaccgaagagtgctgctggggcggggggtggggggagttggaaggaaacgccgtaggatgctcttgggccctgcagcttctccctgggacagaagccatgcgagatgtccctgagttcctgctcccacgggggtgccagcagtgtgcctgggttgatggagctaatggaccgctatgatagtgtggcccaaaagtcttttctaacagtcaccaagacataggttagactcatcagtgaatgacagcccaagatacagctcaggcctgtagtctgtctcctgaccgttgtgagggctccttagcctgctggaccttttacagtgtggcttcgtcagagaatccagtccaatgaggtctccgggacactggtgggagcagccacgatgacgtgaattcccacagaggttcctgagaccgctgtggatgtgaagagtgtgctgaaagctgacagagaaaggggagatgaatagataagtgcatataaggcaataagccagggatggagaggtggctcagcagttaagaacactggctgcgccgggcgtggtggcgcacgcctttaatcccagcactcgggaggcagaggcaggcagatttctgagttccaggccagcctggtctacatagtgagttccaggacagccagggctacacagagaaaccctgtctcgaaaaaaaccaaaaaaaaaaaaaaaaaaaatcaaggaggcttctacctttagggctggtaagatggctcagttggtaagagcacccgactgctcttccgaaggtccaaagttcaaatcccagcaaccacatggtggctcacaaccacccgtaatgagatctgatgccctcttctggtgcatctgaagacagctacagtgtacttacatataataaataaataaataaatctttaaaaaaaaaaacaaaaaacactggctgctcttccaaaggactggggttcaatccccagcacccacatggcagctcacgactcttaactccaggatccaatacccttacacagacttatatgcagacaaaacaccaatgcacataagaataatgtttaataacacaaataagcaaatgtcaagtttgtggcatgcatgaatcctaggtgtgagagagaaacatcatctatttctggctcagcctttcttatacaacacaggactaccttgccctaaggtggcaccacatgaaatgggcagagcccccccccccatattactcaccaattaagaaaatgttacagccgggcgtggtggcacacgcctataatcccagcactcaggaggcagaggcaggtggatttctgatactggcacttagagcctctcattcaaaggatcacggctaagcaggtgctctgtatctgtccggagcagaggggacgagcagcaggtgtccgctctgaaacctggcttctacagaagtgtaaatcctttactaccgtgaggagtctccagtatccacactgtgaataaacaccattatatcttacgtgaggctgccaggacagaccacagactggcttgctggaagtaaccgaagcatgtagtgaggttgctgagaccagacggccagaaccacagtgtgtgtgcatgtgcgcttgcatgtgcatgtatgtgtgtccttctgatacctgagggcacatgtcttcctttgcctttccagcctcccgtgttgtcagccatgctggatgtccctcagcctgtggctgcctctccccgttggctgactttccatagtcatcgtcgctttctcatttgtaaggattcctgacgttggcacaggcctgccctaacggcccccttttgacctgatcatgttcacagactattttccaaagatggtgagagtcatggagactggttgggacttgcgtgtatcattaacaggtacataattcaactggtgtgtgtgtggggggggggagggtgtttcgggcaggtgcaagcgatgaagcatttagatgacctccacgtgtgcacacaggtcacggcgggggcaaggagcaagacatgatgactgtgactagggagtaaggtattgggggcccagagcttgggttggtcctgaggtccactagccgttgccagggattttcaagaggctgttcccaaagtggtcagcagatggcgcaactacccacacatggcctccctgggagatcacagtttggcaggtatgggatgttttcaagtcctagatgaagctgttatctttctgtagaagactcagaagctcagctataacaagcagattcttgccttaatttcctgatgctgtgacttagcattttgggaactcagcgggccctcctttttgaagtgctgagaatggatcccaggcctcccacatgctctgccacttgagatgcttcctctaagactgagccccacctttgatacctgtgagaatcctgagcacgctggggtgggttctcagagctgcatggggctcctccagagctggtaccacacacacacacacacacacacacggaggattgttgtgtgtgtggtccttccagagccagctgcactttgggtcgtgcacagggtgtgcaccgctggaagtttgcctcaggaggcaatcctcgcactgccccaagctctgcgattgttgtgcttcccatgttaacctcggtcactgagtcaaagaatccacaacagatgcagaggtaactttgaaagagaaccgggttcccagactggagaggtggctcagcaggcaaaggtctttgctgccaccctgatgaccagagttcaattcctgggtcccacacagtggaaggagagaagaaactcatgtagattgtcctttgacctccacacactctgagacatacgtatatacacacatgagttaaatgcacacacagacgggactagagaaagagcacagctcctaccacccagccccatcttggcagttgtctccctgatgtcccctctcacatctccctctctgttctcctacagggacccattctgataatccagaatgatctgatctgagaccccctctctcagtaacttcaccaaagaccccgtttccaaatcaggccccacggggggatgtgggcatgaggacatgggctttcctagggaagctatgcaattcagatgtgccatctccccagatgtgaacagataccatccctgcttgcagtgatgggtaaatatcccatacacttgccatcccaggccttcctccctgacccccctgtggtaaagggtagatatacagtgatgggtggaggcctgggatgggccaggccaggcctatgctgggaaaccacatggtggctggacggcagtctgctgtgtagcgttatatcggcttgatactggctagagtcattggggaaacctcagttgagaaaatagcccccaccagacaggcctgtgggcaaacttatgtaacattttcttttcttttcttttcttttatttatttatttatttatttattttggtttttcgagacagtgtttctctgtatagccctggctgtcctggaactcactctgtagaccaggctggcctcgaactcagaaatccgcctgcctctgcctcctgagtgctgggattataggcgtgtgccaccacgcccggctgtaacattttcttaattggtgagtaatatggggggggggggctctgcccatttcatgtggtgccaccttagggcaaggtagtcctgtgttgtataagaaaggctgagccagccttgggaggtaatgcagtggtgagcagaatctctctacggcctctgcttcagttcctgccttcaaattcctgcctcgagttcctggcctgacttccctcagtgatggactctgacctgagagttgtaagaagaaataaatctttcctcttctaatcactttcgatcatggtgtttcatcacagcagtgaaaacagaaactaagacagtagctagatacccattgaagctggacaggctggatgctcagttactgagcaggagccagcctccagggacatagttaggtttcatgtcatgctcaaggtcaggatagagtgagtggtataggccaggcagctggccgccaacagggccaagcctaagccctgggcaaaatcctatgccctgaccccgtagtgagccttagcccatgtgagtcagcgtacttaggggccttccattttggcttctctctcacagcagggttggagctttagaaatggatgtgggaatgggcgaaccacaggcttgtaaatggatcgtttgtcgtttagatggggcattgcatgtgtgctttgctctccagagactatccccatctgtctcttgagttttgccaaattctgctcacccctaatgatgccatctgcccaaacaggtgactgtggtcaccacactgcacctgaggacctgatgatactttaggtgtctgtttctcttttgctttttgagagagagagtcttaacatgttgcacaggtcagcctccaaactccgatccttctgcctcagcctccttggtggagtactgggatcaaagacaggcgtggctcttgggctgtgagccaacctttggtatcacttaggctagcctctcacctgttagaagctgacatgaaaactcagacaaaacactagattgtcctcttgggatggtggccttcggctcagcagctgatgtccctgtggctgctggggtactttgggtttctgtctggagggctatctcttccagctctgagatgcgtcaggctggagagcaggcagccagcatggttctgggaaaggagggagcggtttgctttggaaattagcgctgtggttcgagctctcctcttccccacattattttccctccagccaaagacgattctaattatttccagtagagaatgagacaaggacagcgaaaagtatcgtctgctcggggaacaacggtgaaggccttaatccatgccactgggagagacaggcagagctctgtgaattcaaggctaaactggtctctacagtgagcttgagcacagccaaggctagtggaggtgtggggggagtgctttttaggaaaatgagagcagttgttctccaagtgtgaaaaaaatggaactgcagcctcgcctcttgtctccttgggatgaactgccaagcaaagtccaacccagagtgtcatcagggttgtgactcagtgacattttagcacactgctggtggaagccacggcggcagggtggacggaggaagggaaaatcctaggagatcctaggaggtgggtgctgtagccacgggttctggcctggtgtgaataccactcaattcgtgaaaactcaggactaaataaataaatatatgtgtgggccaggcatggtggcacatgcctttaatctttagcattcaggagtcagaggcaggtggatcttttagttcaaggccagaatggtctacagaaagagttccaaggcagccagagctatatagagaaaccctgtctcaaaaaacaaaaacaaaaaaacaacgaaatgtttgtgtgtggtgtattaatgttttgctttaataaatatatttgtgtttcacatgatgctcaatgtccacagaggctcagaagaggacattggatccctaggaattagagttacagagcattgagtgactggccatgtgggtgctgggaatcaaacccaggtcctctaggagagcagtcagtgctcttaaccactgatttatctttccagactcaagggcaaattcgatctttaccctgtgaatgggatgatcagaccctaaagtggaatgtgacacgtgacctattttcaataaaggatagaactgatggcccaccctcctcctgaagccagcactgtggttcgtcaatatgcccaagcccacaagagggcgccatgccaacagtccagttcctgcagatatcctgaggttcttgacagcacatttaaggcagttgcagctaaattccaaagtaactaaaaggaactggatagattaacctctaaattaatttggaacaatgaccaagaattgccattataagaccaacaagattcctcggcaggtaaaagtgactgttgacaagcctaatgacctgggtttgacccccgtggcacacatcatagaggaaaaggaccagttccatcaagttgtcctctgatccctacacgtgcacagcggcacatgtgatacccaataaatgaatgagtctaataaaaaaatttaaaagtatctgcagggaaaaccaagtaacggatttctcagacctatggatacagctatgtaaagccaatacccagagttatatcaggaaggtctcagtggccagctcttgctctgtcttgttccagcaaggaaggacaactgacacaacaattctagatgcagtcattggaaacacccagaagcgggtgctgcatgtgttgagctaggagagaatatgatatcagtagtatcctggtgaccagctagccattcgtcctctccctgaatggcagacagggatggactccgagtgagaaaatacacacaacagattgaacaacagagcaagcagccaccttcctgagccaagtgccttatgcattttcacaggcatgtttacatgaggacattatcatgcaagtacttgatgaacccggagtgcgctctccccctcgactcgcccctgcacttatttctgagtgatggggagacaagccgagtgcacacctcgtggaattgagccgccctgttgaccatgttgtgactgtcactccagcccgtgagacaatttgaaataatcatgtccaaccagctgtcgtaatttgttagctgtaaagttgcaatatgcttgctgtgagttacagaactgtattaaatacattgtcatttgattcctagttt

SEQ ID NO: 193390 - DNA, 279 bp, Mus musculus
atggagagagcagacatacatctccggtgcaggtaccctgctcagaccaagccggagccagcctactggcagcccattctctccggcaaagctagacacaatatgagcaattgctgcgatttctccataagtgctcttgtttcccctaataattcacgtttcatctccacaataaacattgttagaactcttctctgggctttaaatatacataattgctccccgtgccagtaaaaggtattaattccatttatgcattccataaacttttaggataac

SEQ ID NO: 193391 - DNA, 1982 bp, homo sapien
gtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgataaaaaaaaaaaaaaaaaaaa

SEQ ID NO: 193392 - DNA, 789 bp, homo sapiens
  misc_feature (9)..(9): n is a, c, g, t or u
  misc_feature (21)..(21): n is a, c, g, t or u
  misc_feature (30)..(30): n is a, c, g, t or u
taaacgggnaaagatgccttnctttttaancctaattgaattttaaatgtccttttgacacaaaaaggtatatacatgacacagctacacaaccttttttcaactggacaacaagtgtcaaaaccctgtggatgtatagggtaaaacaagattggtcaggaaaagagaattgttcctataactggtaatctgacacaatgtcctattgccattaaaaaaaaaaggtccattttcagtttattcaagtttattttcatggtgttttatccctcttgataaaaaaaaattcagacttttgtaatttgtgtatgctgatcttcatcaaaaggttcattctctggatcagagtcagtggtgtcagaatatctataatgatcaggttcattgtcactaacatctgttgttacagaagtttaacttgctagcctccggatttgacggctcctctactgcctttgagaagtacagtttcaccttaaattttggagaaaacgttcacgttgactttgtctttattttcttacggcaagacaattttttgttataagtaagttcctatacttcccttgcatttattttacaccctcctatatctgtcaatctttatctatttttttgtttaacaataaacccactaatttccctactttttcttccaacgttatccacctatcacctggatcataaataatgtttttcttccccataagttcaaaactttttccccctctttttttccacccctctttttgattcttcgcaataaacctttatttgttttctccccac

SEQ ID NO: 193393 - DNA, 467 bp, homo sapiens
aagaaatggcatatttgaagaaatcatatggctagacaaaacaaactagatagattgtgaagctagatagactaaacctcagtcttgattactaattacaagctgaatgtataaatcttttccttcagaggcataaaggtaagagttatgaatcaaatggaaggaccaaaatgcttcccaatgaagtattttcttggtgaagttattgcaatctaaggtctgaaaatcagctgtacaggaactttatcagtaacctaaaagatgatcaatcagcctcagtgactaacgacactgagaagagaccaacgtaaaaactagcacaccagattaatttaccacaaagatattctcaccataatcagaaaacctgccctctattcagagtattcactcttttttggtatgagtactaatctggctgggtcgaattagtgcttagttgaatacagaattaaaataatgtgaag

SEQ ID NO: 193394 - DNA, 21 bp, artificial
  targets natural antisense
gcctccttatacaccactatc

SEQ ID NO: 193395 - DNA, 20 bp, artificial
  targets natural antisense
gtgctggatctggtctaggc

SEQ ID NO: 193396 - DNA, 19 bp, artificial
  targets natural antisense
accactgcctctgtctcca

SEQ ID NO: 193397 - DNA, 27 bp, artificial
  targets natural antisense
cugcucuggcuguggucagugccucgg

SEQ ID NO: 193398 - DNA, 27 bp, artificial
  targerts natural antisense
auucccuuccauaggcaugagacuguu

SEQ ID NO: 193399 - DNA, 27 bp, artificial
  targets natural antisense
ccaagcugcuggaagcauguacuggug

SEQ ID NO: 193400 - DNA, 27 bp, artificial
  targets natural antisense
agacggucucauagguggaauuugcug

SEQ ID NO: 193401 - DNA, 21 bp, artificial
  targets natural antisense
gatgtatgtctgctctctcca

SEQ ID NO: 193402 - DNA, 20 bp, artificial
  targets natural antisense
ggcttggtctgagcagggta

SEQ ID NO: 193403 - DNA, 21 bp, artificial
  targets natural antisense
cctgcaccggagatgtatgtc

SEQ ID NO: 193404 - DNA, 21 bp, artificial
  targets natural antisense
ccggagatgtatgtctgctct

SEQ ID NO: 193405 - DNA, 21 bp, artificial
  targets natural antisense
gcccaccacctcattattccc

SEQ ID NO: 193406 - DNA, 20 bp, artificial
  targets natural antisense
ccagtcccaagtccagcaga

SEQ ID NO: 193407 - DNA, 20 bp, artificial
  targets natural antisense
gcctccgtgaactcctcctt

SEQ ID NO: 193408 - DNA, 20 bp, artificial
  targets natural antisense
gttccgcccaccacctcatt

SEQ ID NO: 193409 - DNA, 21 bp, artificial
  targets natural antisense
ggagcaagaacuuucugaatt

SEQ ID NO: 193410 - DNA, 21 bp, artificial
  targets natural antisense
ccaaucagcgcaucuacuutt

SEQ ID NO: 193411 - DNA, 21 bp, artificial
  targets natural antisense
ccaccaaucagcgcaucuatt

SEQ ID NO: 193412 - DNA, 27 bp, artificial
  targets natural antisense
uucauaacucuuaccuuuaugccucug

SEQ ID NO: 193413 - DNA, 27 bp, artificial
  targets natural antisense
auucugacaccacugacucugauccag

SEQ ID NO: 193414 - DNA, 27 bp, artificial
  targets natural antisense
auuaccaguuauaggaacaauucucuu

SEQ ID NO: 193415 - DNA, 25 bp, artificial
  targets natural antisense
gaggcacugaccacagccagagcag

SEQ ID NO: 193416 - DNA, 25 bp, artificial
  targets natural antisense
cagucucaugccuauggaagggaat

SEQ ID NO: 193417 - DNA, 25 bp, artificial
  targets natural antisense
ccaguacaugcuuccagcagcuugg

SEQ ID NO: 193418 - DNA, 25 bp, artificial
  targets natural antisense
gcaaauuccaccuaugagaccguct

SEQ ID NO: 193419 - DNA, 21 bp, artificial
  targets natural antisense
acctctggagctctctggaac

SEQ ID NO: 193420 - DNA, 25 bp, artificial
  targets natural antisense
tatgatggaaaggtgcgcatcctta

SEQ ID NO: 193421 - DNA, 25 bp, artificial
  targets natural antisense
cttccctggattggcagccagactg

SEQ ID NO: 193422 - DNA, 25 bp, artificial
  targets natural antisense
atatgcagaaatggtccctgtcctt

SEQ ID NO: 193423 - DNA, 25 bp, artificial
  targets natural antisense
gaggcauaaagguaagaguuaugaa

SEQ ID NO: 193424 - DNA, 25 bp, artificial
  targets natural antisense
ggaucagagucaguggugucagaat

SEQ ID NO: 193425 - DNA, 25 bp, artificial
  targets natural antisense
gagaauuguuccuauaacugguaat

SEQ ID NO: 193426 - DNA, 4107 bp, Homo sapiens
gtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaaaaaaaaaaaaaaaaaaaa

SEQ ID NO: 193427 - DNA, 26984 bp, homo sapiens
gtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggtactatgaactcttctggttgtttctttggccttctctcatgaaaaagtattttgttcacatacagccaccttaaggttatcgttcattgtttagtaaagtgaatgctgctactgtggcggagtaagatcactcattatggctagaattcctttattcctagaggaggactattatctacttcattttaggagtgagcttattttcaaagagatagttcatatttttaaaatttgcactgcagcgatggtcgttattctgcctgggcttttttaagaggtttgcacaccatataaaagtaacataacttgtgatttttaatattttattagagattgtaaaggttataacatcactttggtgtttcgtagtcaagttttaacataaggatgtgcctgaaaaatcatttgtaattagagaatgggaagattcttgggttgcatttttgtcagcaaattgcagaggatcattattctgctctagagttgcaccgtccagttcagaagccactagccacatgtggctgttgagtacttgaaatgtattgatatgtgcaataagtgtagaagacatattggattttagagatccagtatggaaaatacaaagtatttcattagttttattcatcaaatattaaacaaatattggtttttatatggaaaaaatacttaaaattaattttgaattcttttgaaatacttttgatattgggttaaataaaatgtattttgggctgtgcgtgttgcctcatgcctgtaatttcagcactttgggaggccaaggtgggaggatcagttgagcccaggagtttgagaccagcctgagcaacataatgagactccatctctacaaaataaataataaaatttgctgagcatggtggtgtgcacctgtagacccatccactcagtagtctgaggtgggaagatcccttgagctcaggagctcaagactgagtgaaccatgatctgccattgcactccaccctgggcaacagagcaagagtgtttccaaaatatatgtatgttttttgaagtttactttttttttttttctttttttgagaagtagtcttcctttgtcccccaggctggagtgcaatggcatgatcttggctcatagcaacctctgcctcccaggttcaagtgattctcctgcctcagcatcctgagtagctgggattacaggcgcccgctaccatgcccagctaatttctgtatttttagtagagacagggtttcaccaggttggccaggctggtgttgaactcctgacttcaggtgatccaccctcctcggcctcccaaggctctgggattataggcgtgagccaccgcgcctggccagttttcaccttaatgtggttactaaacaatttaaagttatatgtatgtctcacattatgtacctattgtacagctctgctttagcatagaaagtttaataatgcattacaccattctcaagagattgagtcattagaaaactgttttctttcctgtatttcagtcttttggaaagaaattacaaaatttgttattgttaaacttggaggtatatatatttgaaagagtcattttattttattttactttaagtgccgggatacatgtgcagaatgcgcagatttgttaacataggtatacatgtgccatggtggtttgctgcatctatcaacctgtcatctaggttgtaagccccacattcattaggtatttgtcctaatgcttttccaccccttgccccccacctcctgacaggcctctgtgtgtggtgttccccaccctgtgtccatgtgttcttattgttcaactctcacttatgagtgaggacatgtggtgtttggttttctgttcttgtgttagtttgctgaggatgatggcttccagcgaaggagtcttgtattagtggctttttccccacctaatcgttagaagttgtgaatagggacttctttaatgaatccagaagttaatgaacctagcttttttttttttttttttggagacggagtctggctctgtttcccaggctggagtgtagtggtgtgatctctgctcaccatacaacctccacttcccgagttcaagagattctcctgcctcagccttccgagttgttgggactacaggcgcgtgctgccatgcctggctaatttttgtatttttggtagagacggggattcactatgttggccaggttggtcttgaactcctgaccttgtggtccgcccatctcagcctcccaaagtgctgggattacaggtgcgaggcaccgcgccccgcgccctgccgatgaacctaaattttaactaaacagtggccttatctactttcagaccatgtggtatatttacatgactacaggagaagctttgctaattcagaataaattatgttacttaaattggcgactgtctttaaaaaaaaagtgattttttggatgcagtagctcgtgcctataatcccagtgctttgggaagctgagataggaagatctcttgaactccggagtttgagaccagcctgcgcaacacagtgagaccctaatcactacacccctccaccccatgtaacttttgttttatccaggttgtggtatattaaatgggcattagtgtaaagtgggaaaattatattaattcttgaatatgattactaaactgaatttgaaaagttttcaggctatcaagagaatttttaacttaaaacttatataatttgaactttttacttcatatatccgtaatgatgatggtcatctatatctagcttttagagcagacaactggttcatacctggattaaataaataatgtaaagttattttttgttaattatggattagtgaagatttactgttttaacctactcctgctagtggcactactgcatggttttgaagaccagtgaagtatgacttaaaggtttcttgaattggagctaggacactggcatttataaaatctccacgtagcgcagacattgacactatcagaagaccagcaagtaactagaagttactttgatcttaaatcaactacaaaaaacttgactcactagttatggagaatacattttttattgttaaactgaaaaaaaattcagtcacttataaggtgtagcctcttctaatcctgtttatataaatttatttattattattattttttgagatggagtcttgctctgttgccaggctgtagtgcattggcgcgatctcggctcactgcatcctccacctcccgggttcaagcaattctcttgcctcagcctcccaagtagctgggactacaggcacgtgccatcacgatcagcacttttagtagagacggggtttcaccatgttggcaaggacgtgtctcgtcgtgacctcgtgatccgcccgtttcagcctcccaaagtgttgggattacaggtgtgagccacaatgtccagctgataaatttaattttgcttttctgagttttcatttatggtaatggttaaatcagctaggctttacagttgttactcacatataattctttgtccatcctttaattctcacattgggaactgactaaaaaaagaaagcttccagtctgggcacagtggctcacacctgtaatcccagcactttgggaggccgaggtgggtggatcacctgaggtcaggagttcaagaccagcctggccaacacagcaataccccgtctctaataaaaaatacaaaaatcagccaggcttgggtggcgggcgcctgtcgtcccagctacgcaggaggctgagacggggagaattgcttgaagccaggaggtggaggttgcagtgagccgaaagcgcttaaggagaaataagtaaggacaaagagtgcaggatagtatcctgacacggaggatggggagggtatgtaaatattgtcgatattttactgaatttctaaatattacaagaatagaatattcataggataacctaagcttttctgtgagtcagtgtactaggcagaaagttcactaaagtggtttatgatttttgctacttatgagaaaacattaaaaatgaagccatgaaaaggaaatattggtgaaatttagatacttcagaaggaaagagagactttcttttttttttggaaagaatttctataccatctattatatcattgattgtatgtgattattgagaattaacttgttttttttttttttgttttttttttttgagacagttttgctcttgtcacccaggctggagtgccgtggtgagatctcggctcactacaaccttcacctcccgagttcaagcaattctgctgcctcagtctactgagtagctgggattacaggtgcccatcaccacgcccagctaatttttctaattttagtagagacgggatttcaccatgttggtcaggctggtctcgaactcctgacctcaggtgatccgcccgcctaggccaaagtgctgggattacaggcgtgagtctcccacgcccagcccttaaatttcatttagactggaaatttcaagtaatggagaggtgtgttaaggaagttattgctctgttagagcagtttcttaaatttggcactattgacattttgggctggatttttctttttgtttctgagatagtttcactctgtcgagccatcacagctcgttgcagccttgaactcctgggctccttgaacaggaggctcctgcctgagcctcctgagtagctgagaccataggcacgtaccatatacctagctaaatgtgtttttgactttcttttttctttgtagagtcaagttctcactatgttgtccaggctggtcttgaaatcctgggttccagcaattctcctgcttagccttacagagtgtcgggattgtaggcataggccactgcacccggccttgggctgatatttatttgctatggggaactttcctgtgcgttgtaggatgtttggcaatgtccctggccggccaggtgcagcggctcacacctgtaatcccagcactttgggaggctgaggtgggcggatcacttgaggctgggagttcagaagagaccagccaacatggtgaaaccctgtctctactaaaaatacaaaaattagccgggtgtggtgacacacatgagaatcacttgaactcaggaggctgagtttgccgtgagctgagatcgcgctgctgtactccagcctgggtgacaaagcaagaatctgtctcaaaaaaaaaaaaaaaaaaaaaaaaaattcgctggtctccacctacgtttgtatccccaccccaagtcctgacaataaaaaatgtcttcaaaatgttccttgcaaaattgctcattgaggctaactgaggtggctcacaactttaatcccagccctttggaaggctgaggctggcagatcacttaagcccaggtgactggccctggccaacttggcaaaaccctgtctctactaagaatacaaaaaatagccagacgtggtggtgcacacctgtaattccagctactcgggaggctgaggcagcagaatcacttgaacctgggaggcggaggttgcagtgagccgagatcgcaccactctactccagcctgattgacagagtgagactccatctcaaaaaaaaaagaaattactctctgagcaccagtgtgttacagtgtgcttagctgtggtaccactttggattctttcacacaagaacagttaaggccagttttaaagctgtggggccatttctgaactgtattttgtttttttttttttggagatgaagtttcactcttgttgctcaggctggagtgcgatggtgtgatctcggctcacttgcaacctccgcctcccaggttcaagcaatctcctgccttagcctcttgagtagacttgattatgggatcttggctcactgcaacctctgcttcccaggttcaaacagttctgccttagcctgctgagtagctgggattacaggtgcccgccaccatgcttggctaattttgtatttttagtagagacggggtttcaccatattggccaggctggtctcgaactcttgaccttgtgattcacccacctctgcctcccaaagtgctggtattacaggcatgagccactgtgcctagccaattttttgaatttttagtagagatggggtttcatcatgttggccacgctggtctcgaactcctgacctcaggtgatccacccaccttggcctcctaaagttctgggattacaggcgtgagccacttcgcccagcctgcactgtgttcttatcctgcataatgacttaaattgataataagttgtggtcatggttctcagaaacctaaaataattcactgatgttaataaaaatgagtggttgtatttagagtcaaggcgaaactgaattaggatgtataaaataactttttttttttttttttttttttaagtaggactgttgttcggctgggcgtggtggctcacgcctgtaatcccagcactttgggaggccacagcgggcggtcaaaagtttgagaccagcctgaccaacatggtgaaaccctgtctctactaaaaatacaaaaattagatggatgtggtggcgcatgctgtaatcccagctactcaggaggctgaagcaggagaatcacttgaacccaggaggcggaggttgcagtgagctgagatggcaccactgcactccagcctgggcgagagagtgagactctgtctcaaaaaaaaaaaaaaagaaaagaaaaaaaaagaaaagggactatactatgttcgaagagtgtagtttctgtcccatactgaattcactgttctttccctagtgattaaaatacaagaaaaggtagagggagaaacacgaactgaattttatgaacttaattccaagaatgtatttttacatttgttcaaaaaattattactttattgataatatgcaaacataccagattatgtattaatagttaaaaatttgagttctagaacaagcttattaaaaatcaacgtcagtaaaaagaaaatagatggtagtcacagtgccattcatctgaaaataatgttttaatactcaacatgtatatggattatatatctatacgtttatagtattgtagctggatttatgttacatttttagcataaaatttggcttttgctgggcccagtggcttgcgactgtagtcccagcaactcaggagggtaaggtgggaggattgcttgaaccaaagagtttgaggctgcagtgagctgtgacctcacctctgcacaccagcctgagtgacagagcaagacccatccctgaaaagaaaaaacttggctgttttactttgctttcaatttgtagtatattctacttaatataataaacttactttctgtgaggtgcttgaatactttttaatggttatttatgaagtggtgaactgtaattctgtatttgtacatttggatgtacaaatagtgttgctacagttgtccttttttggtatgtctccagtgttcttaggataaattcctgaaagtgaatttcagttttgaatttcagagaaacatgtcaaagttcttctttaagcctttaagtctcctgatatgttttgtcgtattgcagcttggaaaggttgaaataaaatcctctattagggctgggtgcagtggctcatgcctgtaatccgagcactttgggatttagctgatttggctgatttatcatgccactgccacctgtatccacccaaaatccacaaaaaccccaggatacattcttagcattaaaaaaaaagttatataaatatatataattatatatatatttgagacagggcctgtctctgatacccagacgtgtgcagtatctttcaaaaatcatatatctatatatagtttgccccttccttcagtctttgctgcccctaatatctgtccttaatggttaccatggtgaaactcttggaaatcattcagggggaaaaaaaatttgtgttgggataggggagggatgtcagcataagtttttaatacttgataaatgattgccaacagaatcaaaaacaccttgttttctatcttttttcaccatataatattcttgagaataatttcgtaacagcacttaacagatataccttatttttcaaagaaggctgtgtagcattctattttaaagttgtttcacagtatatgagtctcctattgataggtatctgcatttttgtctttttgatctagggttgtttttaaggcagtttaaaaactatagtaagtaaaagaggccaggtgcggtggctcacacctgtaaacccagcactttgggaggccgaggcgggtggatcacttgaggtaggagtttgagaccagcctggcaaacatggtgaaacccttctctactaaaaatacaaaaaattagccggccgtggtggcaagcgcctgtagtcccagctgttcggaaggctgagggaggagaatcgcttgaactcgggaggcggagattgcagtgagccaataatatgctgctgtactccagcctgggcaacagagcgagactctatctcaaaaataaatacaattttaaataaaattataaaaataaagcagcacccagctttattttttatttatttatttattttttgagacagagtcgcattctgtcgctcaagttggagtgcagtggtgccatcttggctcactgcaacctctgcctcccgggttcaagtgattctcccgcttcagcctcccaggtagctgagattacaggtgtgtgccaccacgcccagctaatttgtatttttagtagagatgggggtttcaccatgtttgccaggctggtcttgaactcctaacctcaggtgatccgcccaccttggcctcccaaagtgctgggtttataggtgtgagccgccgcgcttggctcaacatcttattgtttgagacggggtctccttctgttatccaagctggagtgtagtagtgtgatcttacagctcactgcagcctccaactcttgggctcaaatgattctcctgtctcagcctcccaagtagctagtactacaggtgtgcaccaccatgccctgctgtttctttgttttttttatatggacagtcttgctatgttgcccaggctggtctcaaactcctgagctcgagtgattctgctgcctcagctactcaaagtgctgggattgtaggcgttaactatcaggttaggcctgttctgtttttattagcgtggatgactgctggttactactggccgtttgtatatccttgaattacctctttgtttttagccatttttctccatttgggtgctttttcacagtgacttctgggaatattatgttcttttcttttgatttacctttcaaattttatttttatggatatataatagttgtacgtgtacattatatattcttgaagagttaggcttattgggattccagcctttagtagtcccatgaaggtgagcaaactgaaatgtacttactagtcttagtcatttggttcgtaatatgtaatagaaatggtgcttatcctaaaagaaaaatagaaaacttgagggtgaaggatcagaaattgaagacagtaaatactgcatagaggtttaaatgctagggtttttaggttttcttttttttttgagatagtcttgctctgacacccaggctggactgcaacctctgttccctggcctcaagcgatcctcccaccttagcctcctgactagctgtgaccacagatgtgcaccaccatgcccggctatttttttttgtatttttggtagagatggggtctcgccatgttgcccagtccagtgctggattttcatatcaaaacagggctctgctacttacttgctcttgtgaccaaaatggcaagttaggtttgttttgtatttgttttcatctgcatcggggtatatgttcacagctggatcagcaaactttctgtagtaaggtagggcctggtagtaaatatgtagtatgctttgcagactgcatagggtctctgtcatatgttctttgttttctttacagccttgaacaaattaaaaaacccagtcttcagccttgtctgtagcataataaagaggaaattaaaagtgcttatgttatacgtggtacatactaaaatttattaagtggcgactggcagtttaactaattgacattctcttgtgttaggttaatacaggggttggcgtactatggcctcagtccaaatgtggcccactccatgtttttgtataggctgtgagctaagcattaagcattaatttattacttaaatcaacaaataaagtttatgtggtgtacaacatgatgttttgatgtgtgtacattatggaatggctaactcaagctaatattcattacttcacatacttttttttggtggtgagaacatttaaaatgtactcttaataattttcaggtatacaatatttgtttttgtttttgtttttgttttgagacgaagtctcgctcttgtccccaggctggagtgcagtggcgctatcttggctcactgcaacctccgcctcccaggtacaagcgattctcctgcctcagcctcccaagtagctgggattacaggcgcctgtctccacgcccggctagttattgtatttttagtaaagacagggtttcaccatgttggccaggctggtctcaaactcctgacctcaggtgatccgcctgcctcagcctcccaaagtgctgggattacaggcgtgagccaccgcgcccggctacaatatgttcttaattatagtcagcaatagatctcctgaacttattcttcccagcgtcttcccaatcccacctccaccccctgctaataattaattttaaatgactggggaaaaaattgaaagaactgtttcatgacacttgaacattatataaaattttcatgtcagtgttcataaatacaaacttttattagaacatagccatactatttatatattgaaatacagttgaatttgtcatatgaccaatttattagtattgattaagatgttgagcagtttattcaagtgtggttttgtggaatgaaagagacaggagggattatgaggactctccttagcaggattgatgcatttcactttttttgacaggaaggaaagtttaggttctattttctcagcaactctacttaactgcctccatctgaactatatataggagggggtggatatcagcaaagattaacatcagtaaattttgatgaattctctaaaaattctgatttttaaagagggaattttggctgggcacagtggctcacacctgtaatcctaagcactttgggaggccaaggcaggtggatcacctgaggtctggagtttgagaccagcctggccaacatggtgaaaccctgtctctactaaaaacaaattagctgaatgtggtggcgcgcacctgtagtcccagctccttgggaggctgaggtgggagaattgcctaaacccaggagaggtggaggttgcagtgagccgagattgtgccattgcactccatcctgggtgacagagcgagactctcaaaaaaaaaggtgggtgtgaattttgttatgttgtgcgggctggagtgtagtgcccatccattggcacgatcatagagtactacagctccctaactcccagactcaagtgattctccctcctctgtctccccagtagcaggaactacaggcctgtgccaccatgcccagctttcttagtcttgagggactgcatttacacctatgccttttactctagggtcttttattcatattgctagaaatttggagaagaaagaaaggcataatctctgcagaaaagccattatttctgcagatagttctttttttttttgagatggagtctttctttgtcacccaggctggagtgcagtggtgtgatctaggctcactacaagctccacctcctgggttcacgccattctcctgccttagcctcccgagtagtgggactacaggcacccgccaccatgcccagctaatttttttttgtattttttagtagagacggggtttcaccatcttagccaggatggtctcgatcttctgaccttgtgatccgccgacctcggccacccaaagtgctgggattacaggcatgagccaccacatccggccaatttctgcggatagttctaagctttagttttgaccacgttggttgcctatggccaattcctggattatttgcatgtttccagacacagctatgtgaaagcagggtttgttttaatagtgttttgagcctttgattccagttctgcttccactcttggtctataaggatccctatggcagcaacagaatggcccagccctcatgattggttgcttaaaaaggctttaggatattcaaactgggtggcctgtcttgtttggaataggactaagcatgtcacactttcaccatggaagagttaatccatattctatctgtaagttgtatctccagtcattggttttcaacaagtggtcctatcttaggaggagtggtatattagaacagtccttccagagtaatttttttcattatttcagattttttagttttttttgtttgttttttttttttttttttttaaaggctctcactctgtcacccaggctggagagcagtgatacgatcatagctcactggaacctctacctccctgggctcaggtgatcctcccacctcagccttctgagtttctgggactacaggcatgaaccgtgaggcccagctaatttttgtgatttttgtgttttttgtagagtcagggtttctccatgttgcccaggctggtctcgtactcctggtctcaagtaacctgcccgcctcggccttccaaagtgctgggattagaggtgtgagccaccacacctgtactactactttagtttgaacactatatttaaatctaataattcagacatggcccatttcatacttgacagaaagtatgagtcaaagactcaaatcattcagattctcacatatgtaaaacgtacgcttggccgggtgcagtggctcacgcctgtaatcccagcactttgtgagaccaaggtgggcggatcacctgaggtcaggagttcaagaccagcctgaccaacatggagaaaccccgtctctactaaaaatacaaaattagctggggtggtggcacatgcctgtaatcccagctattcaggaagctgaggcaggagaatcacttgaacccgggaggtggaggttgtggtgagctgagatcgcgccattgcactccagcctgggcaaaaagagcgaaactctgtctcaaaaaaaaaaaaaaaagcaggcttataaaataaaacaaaaatgtcccttatgatttgtcttaaaggtagttgaattaataagagctaaatctagtgtcccatacatctttgtgtttcttactctaccctttagaaagggtgggggtggacgtggataaggcacacagttaattcagggacggtggagtcttggtacttgctctttttccctgaccttgctttggagttattttattttttaaattctgcatttggcatgctattatcacttgcttactattataggtcctattttatctgttgcctagcatattctcatagtgcctaaaatactctaaaagctatttccagagggagctttaatgagacatacaatgcttaatctctcaaatgtaaatgtactagaacaaagcattctggggaagaaaacagtggttgatttaactgaactcacttttccaaaacagtggcttttgattttctgtaaacattgactttattaagcttttcccttgctactatatgcactctctatttcttaaattgcaaagagttattcatgaaatttgtgataaatatttgaatctaaggcaacgtttttggattctttatacgaggtttttagcagcatgtgtacatgtatgtgatagctgttaacggaattcacttaagttttacttagaagcctgggtagtagaacctagaagttgcagtgggaatttttttttaatttgaaagattaaataggtaaaaagtcatctttaatctctattaaacttttttgtataatgtcagaagtgaaagttccccacatctgcttacagcctgtttgtatccttcctgacttgattgattaaatggacatctctatatacatatgcatataatttcaatttttgcttagtaacaaaaacaaaagttacacatactggtgactaatttgcttttttcacgtatgtcatgaaccattttccagggcagttcatctagatctccctcaattctttttaatggctacatattccactattatggatgtaccatatttatacaaccggttccctattgatggacatatggttgtgtctagttttttgctagcattgtgatagattagagcctgtaatgaatggtaaggaagtaagtagatgatagcactactactttgaaggaaaaagtagagaataaacttcctttgccatagtcacttactaaatggaatttaataaaaacactgtcaaaagttgggaggaccaaaattgatactttttctctgatctttttgccatgtgtatatctgaattctttgtttttaaagaagaaacagcattgaagcattatttggggggaaaaacacacacacaaaatccagcaactcagcattcatgagcaactctatactataccagtatgtgcctgtgcagtggaaggaaaacaattttggtaaggattaaaactttagctttaaacttccagcaggttgatattctaatgaatgataaatcaaaaaaaaattttaaatattcttgtattgacagtgcttttttttttaaatcaccctaccttgatatctgtaattttagtttaaactttcccatttttctttaaagaaaaaaatctgaatttgcagccaacaaaaattagatatcctaaggttgtattacttctgacttttattaaaatatcaacatttcttagagatgtttatgggccgactttgtctttttcttcaaggggccaagttcactaattgctgagttttatgcatatgacagcaaccgtccttttgtaggtgtgtgtcgcatccatctagatactttaaaatgctcatctatttcatttttaaaattatgtgtgtgggattatcagtatttttttgttaaacatatgacatctgtagtttatttcactaatgtaaattttttctaccatttgcttgatacaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttagtaaacttcagagtggttttctgtaatttattttagttttataggaagatatttcctataaagctgactgccatcgagaagtggagataaagcattatttaatcatgttatctcatttatcgataacctcagaaaagtagaaaacaaaaataataaaaacagaagtattggccttgacagttaattatagaaaacctcagatattaatttgcttttgatttcaaaagatgctgcagttgcatgcattcaattattttaaataatcttttctggctgagtgcagtggctcacgcctgtaatcctagcactttgggaagccgaggcgggcagatcccatgaagccaagagttcgagaacagcttggccaacatggtgaaatcccaactctactagaaatactaaaattagccgggcatggtggcaggcgcctgtaatcccagctactcaggaggctgaggcacgagaatcacttgaacctgggagttggaggttgcagcgagccaagattgcaccattgcgctccagcctgggagacagtgagactctgtcaaaaaaaaaaaaaaaaaagaaaaagaaattctgaatacaagagtagtattagctgttaatgaagaaatgtgacatctttagtttatgaaactaaaagaactggatagttgagatgtacaggattcagagattcagaaatgtttaaaacaagtatcaacaggccattaggtatctaaagtgtttctaagaactgccgagctaaggtaatagagttggaactgtccaactctgcaggattttagccctggaggagtgagctgttacagttttgttgaaaagagtagctttagaaggcatcattatattagtgtctcagagattgagaatcatattcattctatgtataaatatataaattcttcatcccctagattctcctgtagtatatcacaaaatctgcagtgtgttctgaggtttaaaatcaaagttaaaaacaaaaacaaaaatccttaaaccctcttaacatttgtgatgttaaactttataacgtttgtggtgtgttcaagaaacagaaatacttctttaataaagcatatatatgttgtttgtttttaggttcctttgcaacagcatcttgcctgatttgtaaatacaaagttgactgtgaagctgtacgaggagatatttttaatcaggtaatttgttgcccatattttaggaattgttcatgtctctgaagtatttcttcttttgcctcaaaatccttttttacccctttaaagtatatatggtacagaaagattcaggaagaaaatagttagcatttgggaattttggtaaaatacacgagaacctttcaataccttatatagaaaacagccctataaaggctcttcaaattatgaaattggcttcttagtatctaagccgaacataaaatgtcagatcataagcaagttgttgttgtagtagtttttctccttcctctccctttttgtgcctgtcagatttggaccttaaattagttatggtaatctaaaattatttcatacatgttcattgccaaaaaatataggaaaatttggcagaaaataaaaattatccagaaatatgtcctgtgtgcttagcaatatatggaggtaatcatgtcattacgaaagaggaagaatagtatattaaaatggagtcattggtcgggtgcagtggctcatgcttgtaatcccagcactttgggaggacgaggtgggtcgatcatttgaggtcagaagtgagaccagcctggccaacatggcaaaaccccgtctctcttaaaaatacaaaaattagcctggcatggtggcatatgcctttaatctcagctgcttgggaggctgaggcaggagaattatttgaactcgggaggtggaggttgtagtgagctgagatcatgccacttcactccaggctgggcaacagaacaagactccatctcaaataaataaaatggaatcattttatttgacaaatgtctatttttttttgaaaggatcaattcccatttagtgtatatacacacattatgtttttcctcttaatatatgatggactcttcaatgtcaagtgtttttctacatagatattataacaagagcatagtatttcattgtttcatagtatgttaataaactacccatcattgacagttgctgtttatccatagcttttctgttttgttttttttttaataattctgaaatgtattcttagaggtatggaaatgttgactatttctaacttgggcttactctttgcttctctacctcaaccaaaatctgaaaatatgtaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagtaagttggtgatggtttttggagaacatttctatatataatgtcatgggttgtgggtctgtataatagacgctagtaatcttaactctgcttctgtttgaaagagtggtgaagagctaattttagaaattgtttgtttgtttgtttattgagatggagtttccctcttgttgcccaggctggagtgcagtcgcatatcttggctcactgcaacctccgcctcccgggttcaagcgattcttctgcctcagccttctgagtagctgggatcacaggcgtccaccaacatgcctggctagtttttgtatttttagtatagaccgggtttcaccatgttggccaggctggtctcgaactcctcagctcaggtgatccgcctgtctctgccttctaaagtgctgggattacaggcatgagcccccatgcctggccagaaattctttatttttagtagagatgaggtcttgttgtgttgcccaggctggattcgaactcctgggctcaagtgatcctcctgcctcagccccttgagtagctaggattacaggcacgagcctccacatctggctgaactgtttttttaggtggcattgttcattgagactggtgaatctgacattttgatggggggtggagggttgtcaaaacgcaagtaatgttggtggctcgtgcctgtaatctcagcactttgggaggccgaggtaggtggatcgcttgagggcagcagtttgagaccagcctggccaacatggtgaaaccctgtctctactaaaaatacaaaaattagctgggcatagtggtgtgcacatgtagtcccagctacttgggaggttggggcatgagaatcgcttgaactcaggaggcagaggttgcaatgagccgagaatgtgccactgcactccagcctgggtgacagagtgggactctgtctcaaaaaatcaaaaacaaacccagaagtaatgctaaactctacttctaatttatgtgaaaaattaagacaaaggtagagttcaacttagactttttggtggaatgtgtttttaatgttgcaagggttagcatcaattaatttatgaaatggtcctttatccttatattttttgattacagttttgatctttcaaatttaattgatttcacatttaataaattcaaatgtatagtttggtagaagtgtaacataccatgtaagatggaatttgggggctcagaatgattggttcattcttgtagtaacagccatgccataacggtgatatgtcgatatagtttacccaaaagggtgtgtatataaaagtgttcacataaaatttaaatccttattactctcaggaaaatttctttgtcatatatattctcatactgtctgtttcctcctctagtttagaatcagaggaggagagagagagatttcagttgcatcagatgtgtcctttcataagtgagggaaagaggagaggaaaaatattaaatccctagccagagaattgaattagaccccacatcagcagtcaaggcagccagagtaaacagttggaagaaacatggagtcaagctcttcaattttgtgtctatcccatatctcgtggctttagcagttaactcagtcttacctaattagctgtgaaattctgttaaagtagaatacaagacaatttgcaattaaatgaaacatgaaaatttaatatacaaatctctttgttcttgagttgctcttcttaaagcaaaatcaaaggcactctgcttaaaagcttttctttttattttttagagacgggtgtcttgctgtagctcaggctagagtgcagtggtgcagtttcagctcactgcagccttcaactcctggggacaagcagtccttccacttcagcttcctgagtagttaggaccagaggcgcacaccatgcttggcaaatttttaaatttttttttgtagaaacgggattcactttgttgcccaggctggtcacaaactcctggcctcaagtgatccttcctcctctgcctctcaaagcattaggattacaggcatgagctaccatgcctggtccttaaaaacttttctttcaaaagctttctgtgggatagtatgatgtgttgcaaagataattaaaaaaagaaacaggtttataatagcgtagaatatgtttatatgactttttccctccccccctcccctccctccctcccttccgtttgtccttccttccattcatccttccttctgttagtccttccttctgtccatccttcccgtccgttcttccttccttccttcgtccatccttctgtctgtccttccttccgttcatctgtccgtccttccttcctcccaccctccctccctccctcctatcctccctccctccctcattgcccaggctggagtgcaatggcatgatctcggctcactgcagtctcccgtgttcaagcagttctcctcccaagtagttgggattagaggcatgcgctaccacacgcccggctaattttgtgtttttagtagagatggggtttcaccatgttggtcgggttggtcttgaactcctgacctcaggtgatccgcctgcctcggcctcccaaagtgctgggattacaggcgtgagccactgtacccagctcaccttctttatatcaggagctacttaagtagaacatttatgtaccaagaactcttctgtgcacttgactaactcatttaatcctcaccacagtcttgtggagaagtactattatcatccccattctgcagacaaggaaatttgaggttcagagtgggaaagtctgggaagattgctcaggggtaaccaggtgataggagcagaacttgagcgttttataaaagacacttaactgcccatctgcttgcttgatgaaatgtaatggcttggttaagtatttagtgcatgggtcttttttgggaatttggagctcaagcccttgttggatttttgcataatgtatctgttgtggttttattagcttacttcctcctccctttttctaactcttatttttcaccctattttaggttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaagaaaggcagtcggaccattttgaaagtataaatgtcataacagtatttccaaaaaattagctatttcggcaggttaatcgatagggtagctttatgtagttgattctgtttagagaaactgtacagttcgtaatcagaaaggtaaatcttctggtatcttaacatgatatggagaaggaagtgtttaatagtgctctgtatgttgtgtttctctaggggatggaaaaataagaatgggttattagctggcagaaatgatgacagatttgagtgcttactgtaggtcagctgctttacatatgttacctgattttaatctgaggtaggaactattactcttcttcaggtgggaaaactcaggaccatagaggttaaatacctcatgcacagtaactactaagaagtggaagaaccagattaaaatccagtctatttatgcttagagcctgcccccttaactactatgcggtgttgtctcagatgtagaacacatctttgttttctctgaggacttagaaaaaacacgcgtgattcttctccactgaatataggaatagtttctaccctgtttagaacatgcatagtctttatcaataagtgttaactgacatgtgaaatcactttctactctttggaagccgatgttttaagtccaagtagtctgtatggtggaaattcctaacttatgttaaaaaaaagaaaaccactgtaacttagctataacagtcttatataacttagaactttaagtctcattccatttaccatacttggcgaaaactgacaaattttagacaactgtatttgagtattccagtcatttgctgtaaatacattttagttcagttgaataaacctttggcctttttcatattaggcactgtggtaagttatggagacacagtgattaatgttgtgtataattataaatgtgagtgatactcattaatactttggtataggtgctgctgaagaacaaagtactttattattgttttgaacaaaacatcacacaaaaggtagattttttttttttttttttttttttttttttgtgacggagtctcactctgtcgcccaggctggagtgcagtggcacgatctcagctcactgcaacctctgcgtcccaggttcaagagattctcctgcctcagccttctgagtagctgaaattacaggcatgcgccaccttgctcggctgattcttgtatttttagtagagacggggtttcgccatgttggtcaggctggtctcaaactcctgaccccatgatccatccacctcggcctcccaaagtgctggaattacaggcgtgagccacggcgcccagccccaaaaggtagattctacttggagattagattacagaaggctttctaaggagcaaaatatttaacaataagtagggatttaaaaagagcagacgtgttcacaggggaaactagaaaaagcatagagggatgcttacgtttgcaaatcgtggcagaagtcagaaagtagaaaaattgctactgacttagatacacagttgtctctagcgtatacaaagtctacctatgcactaagacttgcactgggaacttttcttgaatgtcattttgacagatgtgtcaaacggacaatctctttgcccaggaaacagagttaacctggaacagtcatttttttttaaatttatttattttttgagacggagttttgctcttgttgtccaggctgaagtacaatggtgtgatctcggttcacggcaacctccgcctcccgggttcaagcgattctcctgcctcactctccagagtagctgtagctgagaccacaggcgcatgccctcatgctcagctattttttttttttttttttttagtttttgtagaaacaaggtcttgccacattgcccaggctgataccaaactcctgggctcaagcagtctgccagccttggcctcccaaagtgctgggattacaggtgtaagccactgtgccctgcctgtggtgtcttgggaaactcatgagtactatgtgtctgttgtaatagagggaaataagtggttttcacagtgatttgtagtggactgtgaaattttagggattcaggtcagagttgtcacacaggttgtagtcagggtgagaactgggtcatgatgcagtatgaaaaagttcgagagccactttggagagaacttgagataggccacctaccagtgtggtaaccaggcttttgagaattcgtctgggatacggtacaataaatactacatctattatgtgtgaagagatgttaagttagggacatactgtgaattcaaggatagaaaacttttccatcagtttttagggatcctactctttcacttaaaccccaaatggccaagctaggattgatttggtgtgctgtagaaagaacttcattggtattcatggattcacattacatcttagaggagttttcaaaagcgtcttagactgtatgtgtatatacacacacattctgaagcagtaggtgggtcttggggcctgagatctcgggtgaatgtaaatttaggttcacaggtgatactgtagattcacagtgtctacagagtacactatgaatttgtggtgactacattattgacaaaatattttaggtttataatcagaaaaaagttaaaatagttaatgaagatgctttaaaagcctgtgtactttagagaagctacttaacacaaattgggtatctaatgtaggctgggctggatacttcattttcatcaaatctttttaaaataattggtgaaataacctttattgaatatggttttctacatttttcacacttccctccttcatagggttgtgaaaatttatttcatattctagatgaggaaattgaggcacagaggtacacttacaaagatacaataaatggcagaactaagatttgaacccaggactaagtgtattgcttgtatttatttaattaattaatttttaagagacagggcctcactctgttgcctaggctggcccttgaactcctgggctcaagcagtccacctgcctcagcctcctgagtagctgggactgcaggcacaccatgcctcccagttgtttttaaacactaatagtagtctttcataaggacacttataataaaggcagagctggaacccacacttcattccagactgctcagactgagttagtgttagaaaactgaaagtaacatttttattactgtatttcaggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaa

SEQ ID NO: 193428 - DNA, 1028 bp, homo sapiens
cttttcacttgtgaataccaattaggtttccagtttctcataaagatctaacaaatacccaatttctccatcagactgacatcccttaacaaaagcagagtttcaattccctgcatctcctttaggagctatgatataatgtaggtagaaatcttgccttaactccatttacccactgtgctataaataagcagaagcaaatatttttttaaggctggagaggttttaaaaatctgaactaatttagcaactgctgctgcactcagtttttggcagttcccaaacatccattatcatgtaaggataaatccttctaaaccagaaaaatgtttcctacttggaaaaggcataagaaaatacatatacgacctccccatgtactagtcttacataccccagctccagttagaactataatttttttgcactcttgcagtaatttcacagcatcttcaattgtattaatatcttttctttttttcctttttggtggttctgaaaggatattaataacaatctgccacagtgtcatatcatccaactcaggtggaggtattgtttccggcaataaatctttaagaattgttcgaggatctgtgccaatcataagatgttgctgaacaaaagtatatggacctacaataagggggaaaaggcttaaagtcaacttatcaagtaattcaaaatctcatttattttctgaagtaatgagttagcattctgtgagggttttttgcaaagtaagaaaatgcaatttaatggtatttcattctcggtacactcagaattaatgctatatcccaatgagattaggaagatctaatgaagagttgggaagacccccttcagctgtaagtatatatttcaagagtctaattaattaacaaccagaattaagttcttatggttaatatctagaaacacacaccataataccaaaagtatttacaaaagggttctacgacatagaaaaatcgtaccagtcctaaaagcctgtactacttatcattaaaaccacacaggaaaaa

SEQ ID NO: 193429 - DNA, 429 bp, homo sapiens
  misc_feature (7)..(7): n is a, c, g, t or u
  misc_feature (373)..(373): n is a, c, g, t or u
  misc_feature (400)..(400): n is a, c, g, t or u
cgacganaacataagcacttttaatttcctctctattatgctacagacaaggccgaagactgggttttttaggttgtttaaggctgtaaagaaaacaaagaacatatgacagagaccctatgcagtctgcaaagcatactacatatttactaccaggccctaccttactacagaaagtttgctgatccagctgtgaacatataccccgatgcagatgaaaacaaatacaaaacaaacctaacttgccattttggtcacaagagcaagtaagtagcagagccctgttttgatatgaaaatccagcactggactgggcaacatggcgagaccccatctctaccaaaaatactaaaaaaatagccgggcatggtgnggcacatctgtagtactagctacttgngaggctgagacaggagaatcatttgagcc

SEQ ID NO: 193430 - DNA, 156 bp, homo sapiens
cctgtatatacacacactatgcaatagtcttaggtaactaattagctgcaaccctaaggtagatcaaatagaaaatgtcaagtcgccacaatcacatcatcttaattaatatggagggaaggtaggaatctgttactcttcccaacactaagcttt

SEQ ID NO: 193431 - DNA, 593 bp, homo sapiens
  misc_feature (460)..(460): n is a, c, g, t or u
  misc_feature (571)..(571): n is a, c, g, t or u
tctcactgtctcccaggctggagcgcaatggtgcaatcttggctcgctgcaacctccaactcccaggttcaagtgattctcgtgcctcagcctcctgagtagctgggattacaggcgcctgccaccatgcccggctaattttagtatttctagtagagttgggatttcaccatgttggccaagctgttctcgaactcttggcttcatgggatctgcccgcctcggcttcccaaagtgctaggattacaggcgtgagccactgcactcagccagaaaagattatttaaaataattgaatgcatgcaactgcagcatcttttgaaatcaaaagcaaattaatatctgaggttttctataattaactgtcaaggccaatacttctggttttattatttttggtttctacttttctgaggttatcgataaatggagaaacatgattaaataaatgctttatctncacttctcgatggcagtcagctttaatggaaaatattttcctataaacctaaattaatttccggaaaccccttttgaggttaactaccattgcactggaataatctttggnatcccggaaccctgttcaaggg

SEQ ID NO: 193432 - DNA, 14 bp, Artificial
  oligonucleotide targeting natural antisense
ttggtattcacaag

SEQ ID NO: 193433 - DNA, 14 bp, Artificial
  Oligonucleotide targeting natrual antisense
aaactggaaaccta

SEQ ID NO: 193434 - DNA, 14 bp, Artificial
  oligonucleotide targeting natural antisense
gatctttatgagaa

SEQ ID NO: 193435 - DNA, 14 bp, Artificial
  complementary to antisense
gatggagaaattgg

SEQ ID NO: 193436 - DNA, 14 bp, artificial
  complementary to natural antisense
agtctgatggagaa

SEQ ID NO: 193437 - DNA, 14 bp, Artificial
  complementary to natural antisense
tgttaagggatgtc

SEQ ID NO: 193438 - DNA, 14 bp, artificial
  targets natural antisense
aatctgcttttgtt

SEQ ID NO: 193439 - DNA, 14 bp, artificial
  complementary to natural antisense
agggaattgaaatc

SEQ ID NO: 193440 - DNA, 14 bp, artificial
  complementary to natural antisense
taaggcaagatttc

SEQ ID NO: 193441 - DNA, 14 bp, artificial
  complementary to natural antisense
taaatggagttaag

SEQ ID NO: 193442 - DNA, 14 bp, artificial
  complementary to natural antisense
ttatttatagcaca

SEQ ID NO: 193443 - DNA, 14 bp, artificial
  complementary to natural antisense
ttgcttctgcttat

SEQ ID NO: 193444 - DNA, 14 bp, artificial
  complementary to natural antisense
aaaaaaatatttgc

SEQ ID NO: 193445 - DNA, 14 bp, artificial
  complementary to natural antisense
cagccttaaaaaaa

SEQ ID NO: 193446 - DNA, 14 bp, artificial
  directed to natural antisense
ttttaaaacctctc

SEQ ID NO: 193447 - DNA, 14 bp, artificial
  targeting natural antisense
tagttcagattttt

SEQ ID NO: 193448 - DNA, 14 bp, artificial
  targeting natural antisense
agcagttgctaaat

SEQ ID NO: 193449 - DNA, 14 bp, artificial
  targeting natural antisense
ctgagtgcagcagc

SEQ ID NO: 193450 - DNA, 12 bp, artificial
  targeting natural antisense
gtctgatggaga

SEQ ID NO: 193451 - DNA, 12 bp, artificial
  targets natural antisense
gtctgatggaga

SEQ ID NO: 193452 - DNA, 12 bp, artificial
  targets natural antisense
gtctgatggaga

SEQ ID NO: 193453 - DNA, 12 bp, artificial
  targets natural antisense
guctgatggaga

SEQ ID NO: 193454 - DNA, 12 bp, artificial
  targets natural antisense
gucugauggaga

SEQ ID NO: 193455 - DNA, 27 bp, artificial
  synthetic polynucleotide
actgacacctaattgtattcacatgaa

SEQ ID NO: 193456 - DNA, 26 bp, artificial
  synthetic polynucleotide
tgagcagcagttgctaaattagttca

SEQ ID NO: 193457 - DNA, 27 bp, artificial
  synthetic polynucleotide
tctacctacattatatcatagctccta

SEQ ID NO: 193458 - DNA, 19 bp, artificial
  targets natural antisense
ttggtattcacaagtgaaa

SEQ ID NO: 193459 - DNA, 19 bp, artificial
  targets natural antisense
ttgctaaattagttcagat

SEQ ID NO: 193460 - DNA, 19 bp, artificial
  targets natural antisense
gcagcagcagttgctaaat

SEQ ID NO: 193461 - DNA, 19 bp, artificial
  targets natural antisense
gcagttgctaaattagttc

SEQ ID NO: 193462 - DNA, 20 bp, artificial
  targets natural antisense
gccatgttgcccagtccagt

SEQ ID NO: 193463 - DNA, 20 bp, artificial
  targets natural antisense
gggctctgctacttacttgc

SEQ ID NO: 193464 - DNA, 20 bp, artificial
  targets natural antisense
cccagtcttcagccttgtct

SEQ ID NO: 193465 - DNA, 21 bp, artificial
  targets natural antisense
gggtctctgtcatatgttctt

SEQ ID NO: 193466 - DNA, 19 bp, artificial
  targets natural antisense
ttcctaccttccctccata

SEQ ID NO: 193467 - DNA, 19 bp, artificial
  targets natural antisense
attcctaccttccctccat

SEQ ID NO: 193468 - DNA, 20 bp, artificial
  targets natural antisense
ccttagggttgcagctaatt

SEQ ID NO: 193469 - DNA, 20 bp, artificial
  targets natural antisense
atcccagctactcaggaggc

SEQ ID NO: 193470 - DNA, 20 bp, artificial
  targets natural antisense
tctggctgagtgcagtggct

SEQ ID NO: 193471 - DNA, 20 bp, artificial
  targets natural antisense
cctgggagttggaggttgca

SEQ ID NO: 193472 - DNA, 21 bp, artificial
  targets natural antisense
cagatcccatgaagccaagag

SEQ ID NO: 193473 - DNA, 3665 bp, homo sapiens
ggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaa

SEQ ID NO: 193474 - DNA, 16271 bp, homo sapiens
ggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaaggtaagcggtcgtgccctgctggcgccgcgggccgctgcgagcgcctctcccggctggggacgtgcgtgcgagcgcgcgcgtgggggctccgtgccccacgcgggtccatgggcaccaggcgtgcggcgtccccctctgtcgtcttaggtgcagggggagggggcgcgcgcgctaggtgggagggtacccggagagaggctcaccgcccacgcgggccctgcccacccaccggagtcaccgcacgtacgatctgggccgaccagccgagggcgggagccggaggaggaggccgagggggctgggcttgcgttgccgctgccggctgaagtttgctcccggccgctggtcccggacgaactggaagtctgagcagcgggggcgggagccagagaccagtgggcagggggtgctcggaccttggaccgcgggagggcagagagcgtggagggggcagggcgcaggagggagagggggcttgctgtcactgccactcggtctcttcagccctcgccgcgagtttgggaaaagttttggggtggattgctgcggggaccccccctccctgctgggccacctgcgccgcgccaaccccgcccgtccccgctcgcgtcccgctcggtgcccgccctcccccgcccggccgggtgcgcgcggcgcggagccgattacatcagcccgggcctggccggccgcgtgttcccggagcctcggctgcccgaatggggagcccagagtggcgagcggcacccctccccccgccagccctccgcgggaaggtgacctctcgaggtagccccagcccggggatccagagaaccatccctaccccttcctactgtctccagaccctacctctgcccagtgctaggaggaatttcctgacgccccttctcttcacccatttcctttttagcctggagagaagcccctgtcaccccgcttattttcatttctctctgcggagaagatccatctaacccctttctggccccagagtccagggaaaggatgatcactgtcagaagtcgtggcgcgggagcccactgggcgctttgtcacattccaccgaaagtcccgacttggtgacagtgtgcttcccttccctcgccaacagttccgagtgagctgtgctttagctctcgtgggggtgggtcaagggaggatttgaagagtcattgccccactttacccttttggagaaatggcttgaaatttgctgtgacacgggcagcatgggaatagtccttcctgaaccctggaaaggagctcctgccagccttgcacacactttgtcctggtgaaaggcagccctggagcaggtgtttttttggaactccaaacctgcccacccaacttgcttctgaaagggactctaaagggtccctttccgctcctctctgacgccttccctcagccagaattcccttggagaggaggcaagaggaaagccatggacaggggtcgctgctaacaccgcaagttcctcagaccctggcacaaaggccttggctacaggcctccaagtagggaggagggggaggagtggctgcctggccacagtgtgaccttcagaggcccccagagaaggacacctggcccctgcctgcctagaaccgcccctcctgtgctccctggccttggaaggggtatgaaatttccgtcccctttcctccttggggcccaggaggagtggagggtcccgggagaatattgtcagggggaaggcagggggtgtcatgggaatgggtgagggggctgaggtgcagaatccagggggtccctgcaggagccgcagtggtaagctgtccagctggaagcctggtaactgttgttttctcttgagaggggcttcctgtgaccttggctgtctctgggagcagggctggggtacctgagtggggtgcatttggggtgtgtgggaaggagagggaaagaaagatggacagtgggactctcccctagcagggtctggtgttccgtaggctagagtgcccctctgctctgcgagtgctgggcgggaggggagttggtgagagctggagacccccaggaagggctggcagaagcctttccttttgggtgctgtcaggtccgcatgtcttggcgtgttgaccttcacagcttctggcgaggggaggaatgatctgatgcgggtggggagggttagaggaggcctcaggcctaaggtggtgcagggggccccctaggggctgggcagtgccaaggcataaaagccttccctggtccctggtggcatttgaaggtgcccaggtgagaggggcttggcacctcctcaccctgggagggagaagaaaccagggaacaggtaggagtgggagacaggtgaggctttggaaatctattgaggctctggagagatttgtgtagagaggaaaatgtggttctcccccagggtctcctcctgggtttttaccctctaagcaacctgtgggcatgctgggttattcctaaggactagaagagcttggatgggggagggtggttggtgcccttcggtcctcggcacccccctccgtctccaacaccagctcaccctggtatttgtcatgtcagcaggagaaggtcaccatgttgtttttctcgcccctagtccttccttcctgccccagtccaaatttgtcctcctatttgaccttaatacttaccatggctttggaccagggaactagggggatagtgagagcagggagagggaagtgtggggaaggtacaggggacctcgacagtgaagcattctggggttttcctcctgcatttcgagctccccagcccccaacatctggttagtctttaacttcctcgggttcataaccatagcagtccaggagtggtgggcatattctgtgcccgtggggacccccggttgtgtcctgttcgactcagaagacttggagaagccagaggctgttggtgggagggaagtgaggagggaggaggggctgggtggctgggcctgtgcaccccagcccctgcccatgcccatgccttgctctctttctgtcctcagtggtcccaggctgcacccatggcagaaggaggagggcagaatcatcacgaaggtgagtccccctggctgttggatggggttccctgtcctctcaggggatgggtggatggcctaattcctttttcttcagaactgtggggaggaaggggaaggggcacaggaatataaggatcaagaaagaaagagctgggcaccacgaggttcaccctcagtttcgtgaggactctccgctgttcaggtctctgctagaagtaggacttgttgcctttttcttctgctctttccagtaaaattttatttggagaaggagtcgtgcgcacagagcaggaagacagtgttcagggatcctaggtgttgggggaagtgtcccttgtttcccctagctcccaggggagagtggacatttagtgtcatttcctatatagacatgtcccatttgtgggaactgtgacccttcctgtgtgagctggaggcacagagggctcagcctaatgggatctctcctcccttccctggtttgcattcctttgggggtggagaaaaccccatttgactatgttcgggtgctgtgaacttccctcccaggccagcagagggctggctgtagctcccaggcgccccgcccccctgcccaaccccgagtccgcctgccttttgttccgttgtggtttggatcctcccatttctctggggacaccctggctctccccaccactgactgtggcctgtgctctccacctctggggagggaaggccctggggtcttccttcccgcgagtttccctgacctaaatctggcgtggctgggtagtggccagcagtggtgatgcccagcctgttctgcctcctccttccccaccccaggagccctttccttggcctaggacctggcttctcagccactgaccggccccctgcttccagtgcgccacttaccccttccagcttcccagtggtctctggtctgggagaggcaggacaaaggtctttgtttgctggagaaaaggttgtctgcgataaataaggaaaaccacgaaagcctggttgttggagtgtacgtgtgtgctcccccaggcagtggaggccagccctccttggaggggcggctgcctgatgaaggatgcgggtgaggttccccgcctccacctcccatgggacttggggattcattccaaggggaagctttttgggggaattcctaccccaggtctttttaccctcagttaccaaccccttgcccaggccagaccttcctgctatcccctcctgggccacaagcctggccctcctctgtcccaattgtgatgaaggggcagttcaaaacttcttgattagtcatcttctcccctatcgacttggctttaaaaaatgaccttttcagacttctagtctcgttcactctttttgatgatgctttgccgtaacccttcgtgggtagagaaggattctgtgcccattggtggtctggataaaagaaatagagacctcacaggaagcagtggactggcctgtttccccactgttctttctgttttcacacctgtggccttctccccaccttcttcccaatcaacctattgtgtacatagcccccctcattgtcctttattcttctggaaagcagaccttggagggaggagtgagggggaggctcagctgtggtctctggggggtgggggttgggagctggggtggaagtccacgaagcatacacttaagatgctttggtgaagttctaaacttcatattacccaggctgaaaaaagagcacttgttcctagggctggaaatggaagccaaaacaccacctttttcagcctgtttcagcatctttagagatcagcccaacccacttacacagttgagcagagttggaggcctagagaggggagggactggcccaaggtcataccaactcatggccagagcctgggcctcctcactggccaggtgttatttcttccctctgggtagggaacctatttcagggacaggattgctatgtggtagtggtggtggggtgcgataggcgtggcaggctgggccacaatttggagtagtcatgccagagtcctgcatttatttattctcaagggccccgcctctgtggcccagaattaccccttcatgctccagtgcaccccaggcttcgtggccagcctgggaaactgtctctaccctggtctcccttcagatcagcttctagaaatgtttcgtggctacagtggcagcactgttttttccatgatgcaagcagtttgccctcttgggcggggttatcagtggctggcagggctggcacagcgtgtccgcccactgccacctgtgggttccaggagggcccagcccctgtgctgatgcccaccaccttctcagctcatgtctggggaagaggactggcagggggaaaggtgcctcctcctgaaaggtgcctcctctgtttttgcctaatataggcttgggaacactttgatgtcagctaattctgactcctttacttactagctgtgcggccttggggcaacttacttagcctctttgagcctcctgttccccatctgtaaaatggaatctcaatagtgtctaatagtaccatgtggagaaacttgtgtgaaatgatagctgtggactactgtacacagtactcaggatgtagtaagtgctcaataaacagctgttggtatggttgacgttatggtagtggttgtggggaggacgtaggaaactggagactagcttggcaaagctggctcttcctccttttagggaaagcttagagcatccccatggggtatacccatactcagactgtcctctggcatcgaggttggcccaggattcagttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggacttgcctgattcggaagctccaaagagtggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccataataaatgctgtttttactgtgattattattgttgttatccctatcattatcatcaccatcttaacccttccctgttttgctcttttctctctccctacccattgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccttccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctggcctggggacaccgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcacttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgtgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacagtgggaggggacatggggaatggagatggtccctcaccttcctggggcctcctgctctacgctaccccctcgggagcctcctgtccccagggcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaa

SEQ ID NO: 193475 - DNA, 643 bp, homo sapiens
gaacgtggtgatgcggtgcttgggagctggcacggaaccaagagcaacaccagcctgctcagcacgacctggactgggaggcaggctgggtgtcctggagccctgggcaggcagcaggatggggtgggagttaaggaggtctggggaggagaggcttgggcggtacttggcagggagttctctccccagcctgtcaaagcctgctacaccatctcaccagacactcttccgagcccaggcgagccccctactctccccatggcagagcagtcatttggggaaacaggaaggggggcaggctgtagcctgtccccttcaagagaaccagagctctccatgcctgccaagcccaagagaacacacctcaggatgtctgtcacagggaagaaaggagggggagaaggggccagagagggcaagtctgtcccccttaggagaaagcaccaaagggtggaaggaaggtttccgcatcccctcgctctggaagctgggagctgagggaagaggcaaggggttgaggcctggtgggggcttcaatgtccgcacagccgtggaggcagacaagatggtgtgggggaaagggcagggcacaggtgctctctctcagtctctctttccctggaagctcttggtgatgcaaacg

SEQ ID NO: 193476 - DNA, 513 bp, homo sapiens
  misc_feature (2)..(2): n is a, c, g, or t
antggagacaggctgggatcagcactgctggcactacccagccacgccagatttaggtcagggaaactcgctgggaaggaagaccccagggtcttccctccccagaggtggagagcacaggccacagtcagtggtggggagagccagtgtgtccccagagaactgggaggatccaaaccacaacggaacaaaaggcaggcggactcggggttgggccgcggggcggatagcctgggagctacagccagccctctgctggccgtgggagggacagtcacagcaaccgaacatagtcaagtggggttatctccacccccaaaggaatgcaaaccaggaaagggaggggagatcccattaggctgagccctcttccccagcccaggcttggggaacaggggcgatggtaggggcaagtggtttctgggtccctagccctgcgtgaaacgggttccagaccaaagagccctgatgaaggcatgtctctatatactctatccctcttccccagcccag

SEQ ID NO: 193477 - DNA, 27 bp, artificial
  targeting natural antisense
ctgagcaggctggtgttgctcttggtt

SEQ ID NO: 193478 - DNA, 27 bp, artificial
  targets natural antisense
acagacatcctgaggtgtgttctcttg

SEQ ID NO: 193479 - DNA, 27 bp, artificial
  targets natural antisense
gtttgcatcaccaagagcttccaggga

SEQ ID NO: 193480 - DNA, 27 bp, artificial
  targets natural antisense
cagcagtgctgatcccagcctgtctcc

SEQ ID NO: 193481 - DNA, 27 bp, artificial
  targets natural antisense
gtatatagagacatgccttcatcaggg

SEQ ID NO: 193482 - DNA, 27 bp, artificial
  targets natural antisense
ggctggctgtagctcccaggctatccg

SEQ ID NO: 193483 - DNA, 25 bp, artificial
  targets natural antisense
atgccaagtggtcccaggctgcacc

SEQ ID NO: 193484 - DNA, 1340 bp, Homo sapiens
  ref <308>: DATABASE ACCESSION NUMBER: NM_000799.2
  ref <309>: DATABASE ENTRY DATE: 2010-07-25
  ref <313>: RELEVANT RESIDUES: (1)..(1340)
cccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacgaatgtcctgcctggctgtggcttctcctgtccctgctgtcgctccctctgggcctcccagtcctgggcgccccaccacgcctcatctgtgacagccgagtcctggagaggtacctcttggaggccaaggaggccgagaatatcacgacgggctgtgctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccgtcgaggggctctcagctcagcgccagcctgtcccatggacactccagtgccagcaatgacatctcaggggccagaggaactgtccagagagcaactctgagatctaaggatgtcacagggccaacttgagggcccagagcaggaagcattcagagagcagctttaaactcagggacagagccatgctgggaagacgcctgagctcactcggcaccctgcaaaatttgatgccaggacacgctttggaggcgatttacctgttttcgcacctaccatcagggacaggatgacctggagaacttaggtggcaagctgtgacttctccaggtctcacgggcatgggcactcccttggtggcaagagcccccttgacaccggggtggtgggaaccatgaagacaggatgggggctggcctctggctctcatggggtccaagttttgtgtattcttcaacctcattgacaagaactgaaaccaccaaaaaaaaaaaa

SEQ ID NO: 193485 - DNA, 2901 bp, Homo sapiens
cccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacggtgagtactcgcgggctgggcgctcccgcccgcccgggtccctgtttgagcggggatttagcgccccggctattggccaggaggtggctgggttcaaggaccggcgacttgtcaaggaccccggaagggggaggggggtggggcagcctccacgtgccagcggggacttgggggagtccttggggatggcaaaaacctgacctgtgaaggggacacagtttgggggttgaggggaagaaggtttgggggttctgctgtgccagtggagaggaagctgataagctgataacctgggcgctggagccaccacttatctgccagaggggaagcctctgtcacaccaggattgaagtttggccggagaagtggatgctggtagctgggggtggggtgtgcacacggcagcaggattgaatgaaggccagggaggcagcacctgagtgcttgcatggttggggacaggaaggacgagctggggcagagacgtggggatgaaggaagctgtccttccacagccacccttctccctccccgcctgactctcagcctggctatctgttctagaatgtcctgcctggctgtggcttctcctgtccctgctgtcgctccctctgggcctcccagtcctgggcgccccaccacgcctcatctgtgacagccgagtcctggagaggtacctcttggaggccaaggaggccgagaatatcacggtgagaccccttccccagcacattccacagaactcacgctcagggcttcagggaactcctcccagatccaggaacctggcacttggtttggggtggagttgggaagctagacactgcccccctacataagaataagtctggtggccccaaaccatacctggaaactaggcaaggagcaaagccagcagatcctacggcctgtgggccagggccagagccttcagggacccttgactccccgggctgtgtgcatttcagacgggctgtgctgaacactgcagcttgaatgagaatatcactgtcccagacaccaaagttaatttctatgcctggaagaggatggaggtgagttcctttttttttttttttcctttcttttggagaatctcatttgcgagcctgattttggatgaaagggagaatgatcgagggaaaggtaaaatggagcagcagagatgaggctgcctgggcgcagaggctcacgtctataatcccaggctgagatggccgagatgggagaattgcttgagccctggagtttcagaccaacctaggcagcatagtgagatcccccatctctacaaacatttaaaaaaattagtcaggtgaggtggtgcatggtggtagtcccagatatttggaaggctgaggcgggaggatcgcttgagcccaggaatttgaggctgcagtgagctgtgatcacaccactgcactccagcctcagtgacagagtgaggccctgtctcaaaaaagaaaagaaaaaagaaaaataatgagggctgtatggaatacattcattattcattcactcactcactcactcactcattcattcattcattcattcaacaagtcttattgcataccttctgtttgctcagcttggtgcttggggctgctgaggggcaggagggagagggtgacatgggtcagctgactcccagagtccactccctgtaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccaggtgagtaggagcggacacttctgcttgccctttctgtaagaaggggagaagggtcttgctaaggagtacaggaactgtccgtattccttccctttctgtggcactgcagcgacctcctgttttctccttggcagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccgtcgaggggctctcagctcagcgccagcctgtcccatggacactccagtgccagcaatgacatctcaggggccagaggaactgtccagagagcaactctgagatctaaggatgtcacagggccaacttgagggcccagagcaggaagcattcagagagcagctttaaactcagggacagagccatgctgggaagacgcctgagctcactcggcaccctgcaaaatttgatgccaggacacgctttggaggcgatttacctgttttcgcacctaccatcagggacaggatgacctggataacttaggtggcaagctgtgacttctccaggtctcacgggcatgggcactcccttggtggcaagagcccccttgacaccggggtggtgggaaccatgaagacaggatgggggctggcctctggctctcatggggtccaagttttgtgtattcttcaacctcattgacaagaactgaaaccaccaa

SEQ ID NO: 193486 - DNA, 156 bp, Homo sapiens
agcatctcagactgggattatagacgtgagcctctgcgcccaggcagcctcatctctgctgctccgtgttacctttccctcgatcattctccctttcatccaaaatcaggctcgcaaatgagattctccaaaagaaaggaaaaaaaaaaaaaaggg

SEQ ID NO: 193487 - RNA, 27 nt, Artificial Sequence
  Antisense oligonucleotide
ggagaaucucauuugcgagccugauuu

SEQ ID NO: 193488 - RNA, 27 nt, Artificial Sequence
  Antisense oligonucleotide
cucacgucuauaaucccagucugagau

SEQ ID NO: 193489 - RNA, 27 nt, Artificial Sequence
  Antisense oligonucleotide
cgagggaaagguaacacggagcagcag

SEQ ID NO: 193490 - RNA, 25 nt, Artificial Sequence
  synthetic polynucleotide
aucaggcucgcaaaugagauucucc

SEQ ID NO: 193491 - RNA, 25 nt, Artificial Sequence
  synthetic polynucleotide
cucagacugggauuauagacgugag

SEQ ID NO: 193492 - RNA, 25 nt, Artificial Sequence
  synthetic polynucleotide
gcugcuccguguuaccuuucccucg

SEQ ID NO: 193493 - DNA, 4755 bp, Homo sapiens
  ref <308>: DATABASE ACCESSION NUMBER: NM_170735
  ref <309>: DATABASE ENTRY DATE: 2010-07-18
  ref <313>: RELEVANT RESIDUES: (1)..(4755)
cacacacacacacacacacagagagaacatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatctttcttctttgctataatagagtatctctgtgggaagaggaaaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcaggttatatgctagatcttgggggcaaacactgcatgtctctggtttatattaaaccacatacagcacactactgacactgatttgtgtctggtgcagctggagtttatcaccaagacataaaaaaaccttgaccctgcagaatggcctggaattacaatcagatgggccacatggcatcccggtgaaagaaagccctaaccagttttctgtcttgtttctgctttctccctacagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 193494 - DNA, 46159 bp, Homo sapiens
gtaaaccaatagcccccatgctctgtgcgatttcattgtgtgctcgcgttcgcaagctccgtagtgcaggaaggtgcgggaaggtgtgtctgtggcccgggaaacgcacgccctctcccagagaacttgggtgctgggatggggaggaaggggagagttgaaagctaggggagcgagacctcggggcgtgcgattctcactcgctccctcccgccccagcgcccacagccggggtttctgcagagggcgcgggacgcggggttccccggggctgaggctggggctggaacacccctcgaagccgcgggcgtcctgtccaaggcgccccaggagggcgcaggactcgcagggcgatgtcgcggggccctaggggaggaggtgaggacaggccccgggggagcggggagttccgggcgcccctcggttccccgcgcgaggaaaagacgcggcgttccctttaagcggccgcctcgaacgggtatcggtagcgcgggcgagcggggagcggggggcggggggcgggggggggggggcggcgccgtttgaccaatcgaagctcaaccgaagagctaaataatgtctgacccgggcgcaaggcgcagcctggagctccgggtccccgacgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgaggtaggcaagcgctgggaatggggcttggtgcaggagctgcccgtccgcgggagagagttgactgggggatcccccaccccaaagttgtgggacgaggccagtctccttctttcctcccctccggtagaagggacgatttggagttactcttggggagttttctcccccatcccacaacccagaaggtcagccggcaccaccagggaaaaagggacccggggaagtcacgaagtagaggagggaaggcctggaggagacccagagctgcgtgatgggagcaaagacggcgacccggggatccctcgcagccctcccccagcccaggagtagtcgagagagacttagggggccagagctgtcgagggtcctgactgaggggagggtgctggggctaggctaggaatccttccagggggtgggtggtccccgcgccgacttgcggggggagtgggagggaagcttgcgccttcagcccgcatcccttccccggagctgcacacggctacctgctccccaggaattgagactgaagtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagggaagttaagagttttgactttcggggagtggttgggatgtacgtgggggattcttgactcgggttagtctctggggatgcagagccgggaagaggaatgggtgagtgagttactcctggaaagaaatagctgaggattgggggctctgtgcctgacgggcaagaagaaggggagattacagactaggggcatccctaaggaagaagcctcggggctgcgagggtgaactggaggatgcagtgtttgtgtgttgggggtagagcggggatgagggaccggggtggaggggaggcgaggaggaggaggggacccagagaacgaagctagggaaggtagagggtgccctctgccggccatgctgccaagagcagctactgggggcgggaggctgggggtggggaagtggtaaaggaaggttttgcgggatcccttagagagctggtaggagggacttgttgaatggtgctgctgactccagctcggtggggcgtgcgactcgtcgtcggtggattttgactcctcgttcttgtttggcttctatgcaagttttcctcgcgctgggggagctttgataagcctcgattggcggtgtgttagggcttcttggatcttattttagggtcctctagttatcctgcacttactccttaatgtcagtagcaaccaaagaacattttccgacaagcacgcaggaatgttcttggccagaagcaaagaaaggcatatttctgagtgtttattaatcctcctagtaatcttttaaagcaaagtaatatgtaattgggaacgttgattttctaactgcatataaaaggcgacatgatattaaatgagacccctccctactgactcaatatcctgcaaaatctctctctcccctttattattatggaaaaatctatttttatatgagtttgttgtaaggtcaaaagccattttggtcttacaatttgatatgtctttacattttaacttattgaggcataattacagatttaatttgtatgaacgtgtgtgccttcaatgcttatctcatgcaacataatttttaggttggagatttctgatgttatggcatgtagcgtttcaaggcattacacataataggtaacatagcatgttgaaattacaccacaaagttttgaccctgggaacagcaccttttaaaaacaatcactaaactcctgttcctgttttctgattttgcaaatgccttgcttaagacttttttttttttttttttttttttttttttgggaaatttacctctgggttagcaggagaggtaaaaaaaaggaaagagacacttgttgaaatgtaaccataacctttactggaatttaaaacatgttggtcaccattactggaattccagggccataaagtcgttgtcttttttttcttctacttcattttgtaaaatgtgataaatgttggtaaatatagaccagtagtaagtattatgacactaaaagcattatgtatgtggaactattttaagttattacagaacattttctatttataaatgatataagcagaaagaaatgatttccagataaacaaggcttacgtacatgttttgaagcattagaacattgcagacactcttagacatcacattttttaaagcaaaataacagtaatttttcacatacctttggagcctttcatagcccattcagagctgagttagtagctggaagtttcctttattttaaggtgatattttaaaaccatttaacatgtatagtaggtcaacattggtgcatccagaaaatgaagcatttaggaaatctgtttcagtgtcttttcaatgtgtgtaacttttacttgcaaaccaatggaaccaagaaagtcatcatttgcctaaaatgcagtcatcacctcaaatgattcatttatactatgtgagttaattgccttcatctcattaatggccaaggagggaagggaggtcctggggtatttcttgttcattttgactcaccaggagggaaaatcctgtaaaaaaagaaatgcaaatttctaaaatcctggctcaaagtccgtgggtttcctgtttaaaaggggcgccatgaaaatgtaagctattccctttttcctggaatctttaagagtcccagcttttcaatagtcaaaatgtagatgattgatatcatttcttatatgaatagcactggtttgtagttcagcacgcacagtgagctgggcacgcccacctgatagtatagcagagaacttgtttacattctttttacattcatcttctaaaacctggggtgctctctctctctctctctctctctctctctctgtgtgtgtgtgtgtgtgtgtgcgtgcacgtgcgcgtgtgtgtagagggggagagagagagagagagaactgtgaactgtgaaatataacacagccagcagctttgggtctcaatcgtagacttactcttaaggaaatttacagaatggaaaggtcatgttcaagtagtttattaacattttgagatgtaggaaattaatcccggagtacagaagaacaatttcagacttcctgaataaaaacagacagcatagagagtggatgatagctaaactctgaatatcttttgagaagaaaggcactcccatttcaggtgcccataatatggatttgattttagtgattaaaacattaattttcaacttgcatctccctgtgtggaagagttcaatttgtgtgaggggtctcgcctatccaacaaaagtgaatatgtcccttttatagggtaattgctaacttgtctcaacttgttttcaaacaattgttatagagcactcagtttccactaattgcaaaattgttgcttaattgaaggactctcagccatctagtgcagccattcagccactggcaggctctgtgatctcaaactgtgaattgcattttaaagaggaatcgaggagagaattctgtggaattctaggttttaagtgctggctgttgttcaatggaagaggaaatcatttgaacaagaatcgcatcaagttgtgttgtgataaattttctttattaggatgaataacatgcacagatgagcttcaaaagtgaatgagcaaacttactggttacactctgcatccatttactctgtttagtatggagtaatgttaggcaataaatgatgctggcaaatgaaatccgtatgttatttgcatgtggtatttaaacctaggaaacatagagtggctttggtatttgtaggcttagtcatgtgtgtcctaaacgtcctcttaaacttctacttaaggcatagaattatttaatcctaaataattttatacttaagtgcctcactggatttccagaatatttacactgtaaagatttagaaaggtcatgaacccaattattgactatatggaatcattattgatggcagatgcaaaatggagctcactaatgtactgacattgaaaaccttttgcaggggagaggagggggagtggtaaatgtgtgtgttctttaagtggaacaggaaggtattctcttttctgtagaaaaatttgagtatctggtcagataagtgtggaagctttcatttaaattaagtatttaagttcaagtagaagctctagggcacttatcctcttgatgagacaaatcttatcaaatatactagatgctaagaagtggctcattgccctgatgtctcatttatagattgatgtttgaggatgggttgcattaagtgagttagggggctgagtgtgggacaggagaacgattggaaggaagcaaagtaaatttacaagctttagtgacagccataataaagtaaaagtttatttccagagagcctagagagtaaggaacgttatatagttttccccaaaggttcacttgaaagaacttttcattggttgtcatggtagtaatgtcctgattttgaaatctcccagaacctagtagctcttaaacatgctttcatcttggttcctttggtctgacggaaactttatgacgaccctctgtgtttttgacatgcctctgcatttttggagagaggaggtcaggcaagggaggatttcttaaaactaagacagtatagtaaggaaacataaaattatatgataaaaaatcactgaacttcaaattgacttactgaaataaaacctagaaggcaacctgtcgtttaattacaactagcttgtataaaattaaaatttataaaatgggaattcaaagaaaataaacgggcagttccaagtaatttaagcaactcaccaaaaattgaagtaatagtgccacctagagaacaaaatcaccagctttactagccaaatggcttatttccatatgaaccatttttccaacgctacagttactaggatttccttgttaccatattcagatcttgtgagtgtgtatgggggtgggggttgcatgtggaattacagatgaaattttaaaacaagcagatccacaatttgatatatgcactaaatccttttaacgttgtaatgtagccaaatgtagaatagcatgccaggaatcaacggctagcatcctttttaacatttattattttcatggatatgtaccaaaccgaaccattgagtataaaggttctgattttatttatttgctacaggcaattcattatactttctgagatacaataacaccaaataatttgagtagagagacctttaagaatgttttcgatttatgatctacctttaactttaatgtactcagaagatgtgagaataaaataaagtcaaatataagcaagattttaaacacacacacaaaaaacaaacaaacaagaaaaaggaagaaaattataaggattgccttaaccttagaatagatgaaggtatacatctgagccagcaccaaaaaaaaaaaaaaaaaaagttatggaaccaggaaccaataattacaaattgacttaaaattcttggatgacaaaaatctatatttagttcatttttgcatgcgcccacaacagcatccaaaacagttctggggaggcactttgataaatgttgctgaatgcactaatagattgattaatggctgcttcagattatcactagtgatgtagacagaaacttcatgaaaatggtttgtcttgctggaagaaaggcagaaattggaggaaaaggtttaataatatttttccccagtacctattataaaagtcatttagttggcttagttctataatttcttatgtgtaatttgattcacttatgaaattgtgaatatatgaaatgttaaagttgatttagacagcaactataagcttgtggattttcttttaaatgtcttcaaatttttaaatgccagtggagatgccagcgactgtgcttcagggagtagaatatagtatatcttaaatttgtgccaatttctggtaagcagagaaaaaattgcatgataaccaaagaaagtcatattgtttgtgctttgtgttattcatggaagcaatcaggtgcagaaaactttctttttcagaaaaaaaaaattactaaaataaaggtgcgtgtgtgtgtatgcacatatatctaaagggagagagggagaaggaaacttactaaataaaatttttgccacatgggatttagtctaatcagtcttggttttggagttgctatcatcagtagttccattttgtgattctttctttctgccttcatgtgcctttgaaaactgaaactatgcccaaattaaaacaagtttttctgtcttttcacatgttcacttatttcttgaatgtgtttttaaacacagacaaacttcttttacatcatgtagaatctgaaggtcgagaaatttgcagtcattttgctggagagagatgcttggcggagtcccaggccacattcctaggccaaactctcgaaggtattcctcttatgcaacattgggaaaatacatccagcaccgacatgttggctgataatgtgtctgaaggcacagacgatatgcttatcatatgaaacataaagccagcagatattgcagacattctgttgaatgatagaatctggatcatttacatttacttaaatgtaaaatactatgattaagtacaaaaaaatcaatttaggagagaatagagagttgcgggcacggttttaggggatgacttatcagcagattgtagaaaggaagcttgaatgttttaaattaactgcaagttcagtataagccagtggtgtgacaagaggctgttatcatagctactgaaattttgggctgcactgctagaaatataatactgaaatggagaagctaataattcttcactttttaaatagactgtatctagaatattatcatcagttcaaggaaatgaaataagttgttttaggtacatcatcgataaattagtgtacattcaaatcactgtgaccaggatgcatagggaatttgaaagcattgcatgtgagcaatggttgaggggacttggaatgcatgacttagggacaagaaaacttaggctggaatggcaagtggtttttgaatgttgggttgagaagaattctaaaactgtgaaggattagtaaaaataacattcagattgctaatgcctactgtggctgggagattagagtgtcaacatgtgtgatgtatttttgacatccttattttgaggatgggcttcaaagatttgacgaactgtcataagtgtaatttgtgttgcttcagacagcagttctagaaccaatgatgtaaatttagatactctacatggtagttagaaaactttccattaatttaatttagcaaatattgaatgctcactgcatacagagcactttattagaggaatatataataaagaaaaaagaggtctggtgtggtggctcatgcctgtaatcccagcactctgggaggctgaggtgggaggatcacttgagcccaggagatcattacgagtctggacaacatagcaagaccccatctttacaaaagacaaaaaaaattatccaagcctggtgacaggcacttgtagtcccagctacttgggaggctgaggcagtaggatcgtttgagcccaggaggttggggctgcagtgagccgtgattgtcccactgctcttcagcctgggtgacagagtgagaccccgttggagggaaggaagggaaggaaggaagaaaggtaggaaggctgaaatgaaacccttttagaaatgacactaaaatgggaggttggagtaaggtattttctgaagtgcctttgtacttgtttttttctaatgcattggccataagtctgctccttatttatagtccataaacaatcctaatgagaacagttatatatttctgcctttgaatcatctacttgaagtgtttagcatcatgaattgagtatcagaaatccctcccatttctttgcaaagcgctgtattttacttttccttatttgtatacagattctcaaaattggctatttttcctttgggttagacagaacagaatgtctggaaaaaaaagttcttatcaaattcaggtgcccaaattgcttaagaaattaacttttgaggttatatttttttagggttcagtagctaaactaagaaaacttctcaccgttcaccttcacttttggaaaccacaaaatcttcagatattacagttttccaaagagtttctctttttaaatataaactaaaaggaattgactcctcccccaactccctcaggcctcagcatggatagagttactttttttctttaataatttatttataacttattttgctcttctgtagaacagctggagattaagcaacatggccatgacataaaatgcaagttagaccataagatgagcagcccactccaagtatgaatgagtacttattctttgtgatctctcatactgcttttaggtattaatagtgtcagtcagcaaagcaaacagtttaatatttacatctcctttaggatatcatatagtttatagtttgtatgtgttcttgcgtgtatgttttcttctgtttcaaattcttttttcttaaagtaagaatgttatatgtagcaaatggttctttcattaattcatttgttaattcaccgtgcattaattgagtgcccagtgagtgtcaggcactgggctacttggatttcttttccctgtattgatccatatatcttcaggtgctccttgatatggctctccattgactctctcatataaggctttcattacctattcacatactccctcccaaagaggactggtccaaaagtaaaatcttgagcaagttctctgagttatttcagaacttcttgcccccaaactgtatttttaattattgactggtagcattttggaataacttacctctcttttttaaagattgaagttctttatcctctctgattttcaggtgtcagtttgtgtacaaattgagacaataaaaatgtttgttagacattttcttaaagcattttgctatgtgagaatctttcatgaagaactctttttaacaatgactctatagcagaagccacagtagagggagaactactgaatcaaagatggtgtttgagtctatgattttatgatggattttttttttttttacatacaaggatatgcatgggtcttttagtattcaggaatctgttcttcacttgacagtatttataaattgtgtgtttccccctaaaaaaacttaaattgtgagaatgcttccatttactagaagttggttaatgattatgccaaataaggaaaataagacagaaaaatcagtttagtgaatactattttgcctttaaatttagtaatttagtaacagtatctctttggggtttactagaaaccactttttaatccaataggtctctttcattgtgaagtcaggaggtgattttgcttaaatgtgtagtataggaatctatatgtggtgttcaaggatcatgtaaatatgctgatataatcggagcacagtttggcatcattaactcagaaatatttaaactcttgctatacaacatggaagcaaacttgtgcatagtttgtgtgtgtgtgtgtgtgtgaatctcaaaaaaagaaaaaaatcacaggatcaggaagtcggaataggtcccacttttcttctagtaccaaacctacagccatgttcctagccttctcttttactcccaagcaagacagacaggcaaatgaccatcctgctgcccatttctgtgtatattcacttgcattgagagttgtattcacctgcttgttgagagtattcacaaatggtacctgataaagtagatacttctttaaacatgtgaatttttttgcattgtataatgtttagaaataatcatgtataaatggttgaatattaatacaggattgccttatcaagtattttattaatcattaaaatgtggtgtcattaatacaatttattttaagtgcttttcctaaaataccagattatttttctgattttcacatccctgacaatgactttcttaaacttggtagccaggaacagaaaacctaacactgcatgttctcactcataagtgggagctgaacagagagaacacatggactcagggaggggaaccacacacactggggcctggagcagggggcaggggaagggagagagtgcgtcaggacaaacagacaaatagctaatgcatgcgagccttaatacctaggtgatgggttgataggtgcagcaaaccaccatgacacatatttacctatgtaacaaacctgcacattctgcacatgtatcccggaacttaaagtaaaataaaaaataataataaaataaaataaacttagtagcatctattgttccagagcctgtaattgctcttcaggcagtctcacataaaaacctaggagaaccttcactgtcactgttccatgaggtgttaggaaaacttgctctactgcagtgccccagtaggcattggtactgagaccaaaattcagctggtttgttgttactacgattcctacgtgatttcacttgtcatgtagacaagattgcacacttcaataataatcttgtccaaatgtgtggtattccatacatttttaaaatgcattcacatatctcattccatttgatcctacaaataactctataaaaaagattggcagacattatttctatataacagaggaggaaactggagcttagagaagctaaatagcaatccaaaatgcacagctgtagaaccagagcaaggatgatagcccagtgacttcacctaacctagtccccttaccaccactccagctgtctataaccaaaacctgcagtattcaagtaagaaaccatatcttgcccttgatgcattaatgtgagacctggagcaggaacaggctgatattgtcaccctggcctactgtccacctttgtctccagcagagactggtacccttctgtgtgccaaggaataaagtggtaatgggaagattaaaaatgttttttccaaggagttttttaatttaatttttttaaaaaagaaaaaactcttagagggaaaaatgaatatatgacttttgatgtattgttccttagtaacttagttataattttacttaaacctgagactcttgctaagtgaatgattagaaatattaggtggctggccagatggcaaataggaacagctgcagtctgcagctcccagagagatcaatgcagaaggtgggtgatttctgcatttccaactgaggtaccgggctcatctcattgggactggttagacagtgggtgcagcccatggagggtgagccaaagcagggtggagcattgcctcactcaggaagcgcaaggggtcaggggaactccctcccctagccaagggaagccctgagggactgtgccatgagggacagtgctatctggcccagatactacacatttcctacagtctttgcagccggcagaccaggagattcccttgggtgcctacaccaccagggccctgggtttcaagtacaaaactgggtggccatttgggcagacacccagttagctgcaggagttttttctcataccccagtggcacctgaaattccagtgagacagaaccattcactcccccggaaaggggctgaaggccaggcagccaagtgatctagctcagcagatcccacccccatggagcacggcaaggtaagatctgctggtttgaaattctcactgccagcacagctgcctgaagtcaacctgggatgctccagcttggtcgggggaggggcatccgccattactgaggcttgagtaggctgttttcctctcacaatgtaaacaaagccactgggaagtttgaactgggtggagcctaccacagctcagcaaagcccctgtagccagattgcctctctagattctccctctctgggcagggcatctgggaaagaaaggcagcagccccagtcaggggcttatagataaaactcccatctcatgggacagagcacctgggagagggggtggctgtgggcccagcttcagcagacttaaatgttctttgcctgttggctgtgaagagagcagtggatctcccagcacagcacttgagctctgctaagggacagactgccttcttaagcaggtccctgaccctcgtgattcctgagtgggagacacctcccagcaggggtcgacagacacttcatacaggagagctctggctggcatctggtgggtgcccctctgggacaaaccttccagaggaaggaacaggcagcagtctttgctgttctgcagcttctgctggtgatacccaggcaaacagggtctggagtggacctccaccaaattccagcagacctgcagcagaggggcctgactgttagaaggaaaactaacaaacaggaatagcatcaacatcaacaaaaaggatgtccacacgaaaaccccgtacaaaggtcgccaacatcaaagatcaaacatagataaatccacaaggatgaggaaaatccagcacaaaaaggctgaaaattccaaaaaccagaatgcctcttctcctccaagggagcacaactctttgccagcaagggaacaaaactggatggagaatgagtttgatgaattgacagaagtatgcttcagaaagtgggtaaaaacagactcctccaagctaaaggagcatgctctaacccaatgcaaagaagctaagaaccttgaaaaaaggttggaggaattgctaactagaataactagtttagagaagaacataaatgacctaatggagctgaaaaacacagcacgagaactctgtgaagcatacacaagcttcaataactgaatcgataaagcagaggaaaggatatcagagattgaagatcaatttaatgaaataaagcatgaagacaagattagagaaaaaaagaatgaaaaggaaggaacaaagcctccaagaaatgtgggactatgtgaaaagaccaaacctacatttcattggtgtacctgaaagtggcggggacaatggaaccaagttggaaaacactccttaggatattatccaggagaacttccccaaactagcaagacaagccaacattcaaattcaggaaatacagagaacaccacaaagatacccctcaagaagagcaaacccaagacatgtaattgtcagattcaccaaggttgaaatgcaggaaaaaaagttaagggcagcgagagagaaaggtcgggttacccaaaaagggaagcccatcagactaacagtggatctctcagcagaaaccctacaagcctacaagccagaagagagtgggggccaatattcaacattcttaaagaaaagaattttcaacccagaatttcatatccagccaactaagcttcagaagtgaagtagaaataaaatcctttacagacgagcaaatgctgagagattttgtcaccaccaggcatgccttacaagagctcctgaaggaagtactaaataaggaaaggaaaaaccggtaccagccactgcagaaacataccaaattgtaaagaccattgaaactatgaagaaactgcatcaactaatgggcaaaataaccagctaacatcataatgacaggatcaaattcacacataacaatattaaccttaaatataaatgggctaaatgccccaattaaaagaccacagactggcaaattggataaagagtcaagacccatcagtgtgctgtgttctggagacccatctcacatgcaaagacacacataggctgaaaataaagggatggaggaagatctaccaagcaaatggaaagcaaaaaaaaagcaggggttgcaatcctagtctctgataaaacagactttaaaccaacaaagatcaaaagagacaaagaaggccattacataatgataaagggatcaattcaacaagaagagctaactatcctaaacatatatgcacccaatacaggagcacccagattcataaagcaagttcttagagacccacaaagagaccaagactcccacacaataatagtgtgagactttaacaccccaatgtcaatattaggtcaacgagacagaaaattaacaagcatattcaggatttgaactcagctctggacccagtggaactaatagacatctacagaactctccaccccatatcaacagaatatacattcttctcagcaccacatcacacttattctaaaattgaccacataattggaagtaaaacactcctcagcaaatgcaaaagaatggaaatcataacaaacagtctctcagaccaaagtgcaattaaattagaactcaggattaagaaactaactcaaaaccatacaactacagtggaaactgaacaacctgctcctgaatgactactgagtaaataacaaaaagaaggcagaaataaatacattatttgagaccaatgagaataaagatacaacataccagaatctctgggacacagctaaaacagtgtttaggggaaattcatagcaataaatgcccacaggagaaagcaggaaagagctaaaatcaacactctaacatcacaattaaaggaactagagaagcaagagcaaacacattcaaaagctagcagaagacaagaaataactaagatcagagcagaactgaaggagattagagacacaaaaaacccttcaaaaaaatcagtgaatccagaagctggttttttgaaaagattaacaaaatagatagaatgctagccagattgataaagaagaaaagagagaagaatcaaatagacgcaataaaagatgataaagaggatatcaccactgatcccacaaaaatacaatctaccatcagagaacactataaacacctctatgcaaataaactagaaaatctagaagaaatgaataaattcctggacacatacaccctcctaagactaaaggaagaagtcaaattcctgaatagaccaataataagttctgaaatcgaggcagtaattaacagcctaccaaccaaaaaaagcccaggaccagacggattcacagctgaattctaccagaagtacaaagaagagctggtaccattccttctgaaactattccaatcaatagaaaaggagggaatcctccctaactcattttatgagtccggcatcatcctgatacaaaaacctggcagagacacagcaaaaaaataaaattgtaggccaatatccctgatgaacattgatgcaaaaatcttcaataaaaaactggtaaactgaatccagcagcacatcaaaaagcttatctaccatgataatttggcttcatccctgggatgcaaggctggttcaacatatgcaaatcaataaagataatccatcacataaagagaaccaatgacaaaaaccacatgattatttcaatagatgcagaaaaggcctttcataaaattcaacagcccttcatgctaaaaactctcaataaactaggtattgatggaacatatctcaaaataataagagctatttatgagaaacccacagccaatatcatactgaatgggcaaaagctggaagcattcatttgaaaaccggcacaaaacaaggatgccctctgtcaccactcctattcaacatagtattggacgttctagccagggcaatcaggcaatagaaagaaataaagcatattcaaataggaagagaggaagtcaaattgtctctgtttgcagatgacatgattgtatatttagaaaaccccatcatctcagcccaaaatctccttaagctgataagcaacttcagcaaagtctcaggatacaaaatcaatgtgcaaaaatcacgagcattcctatacaccaataatgacaaacagccaagtcatgagtgaactcccattcacaattgctacaaagagaataaaatgcctaggaatacaacttacaagggatgtgaaggacctctttaaagagaactacaaaccactgctcaatgaaataagagaggacacaaacaaatggaagaacattccattctcatggataggaagaatcaatatcgtgaaaatggccatactgcccaaagtaatttatagatccaatgctatccccatcaagctaccattgactttcttcatagaattagaaaaaactactttaaatttcatatggaaccaaaaaacagcccgtatagccaagacaatcctaagcaaaatgaacaagctggaggcatcatgctacctgacttcaaactatactacaaggctacagtaaccaaaacatcatggtactggtacataaacagatagatagaccaatggaacagaacagaggcctcagaaataacgccacacatctacaaccatctgatctttgacaaacatgacaaaaacaagcaatgcagaaaggattccctatttaataaatggtgtcgggaaaactggctagccatttgcagaaaactgaaactggaccccttccttacacgttatacaaaaattaactcaagatggattaaagacttaaacataaaacataaaaccataaaaaccctagaagaaaacctaggcaataccattcaggacataggcatggcaaagacttcatgactaaaataccaaaagcaatggcaacaaaagccaaaattgacaaatgggatctaattaaactaaagagcttctgcacagcaaaagaaactaacatcagagtgaacaggcaaccgacagaatgggtgaaattttttgcaacgtatccatctgacaaaaggctaatatccagaatctacaaggaacctaaacaagtttacaagaaaaaaaacaaccccatcaaaaagtgggcgaagggtatgaacagatgcttctcaaaagaagaaatttatgctgccaacaaacatacgaagaaaagctcatcatcactggtcattagagaaatgcaaatcaaaaccacagtgagataccatcttatgccagttagaatggcgatcattaaaaagtcaggaaacaacagatgcaggagaggatgtagagaaataggaacacttttacactgttggtgggagtgtaaattagttcaaccattgtggaagacagtgtggtgattcctcaaggatctagaaccagaaatatcttttgacccagccatcccattactgggtatatactcaaaggattataaatcatgctactataaagacacatgcacatgtatgtttattgtggcactattcacaatagcaaagacttggaaccaatccgaatgcccatcaatgatagactggataaagaaaatgtgacacacatacaccatggaatactatgcagccataaaaaaggatgagttcatgtcctttgcagggacatggatgaagctggaaaccatcattcttggcaaggtaacacaggaacagaaaaccaaacaccacatgttctcactcataagtgggagttgaacagtgagaacacatggacactgggaggagaacatcacacactggggcctgtcagggtgtaggaggctaggggagggatagcattaggagaaatacctaatgtagatgacaagttgatgagtgcagcaaaccaccatggcatctgtatacctaggtaacaaacctgcacgttctgcacatgtaccccagaacttaaaagtattattattattattataataataataataaaagaaatacaataaaatagaatgcagcatacagcagtgattctcaaacacattcagcatcagaattacccttgaatctttaaaatatatatacatatgagatcttagtctccaagatttgtaagtttggtattgggtccctgggcctatgttgggtttagaaacttctacagatggtttggatgtatgggacagtttaagaatcgctgaactaaaatcaaataaactgaatatcctgtgatttagagagacttatcgtttatttcactatccaagtacttgcattagagcgtggctagaagggatttgcagccttgtaaataatcagaaattcagacattttgagatgagagaactgctgaagattttattctgacttgaaataaattttctaattagaaacttccaggtgagagcaaaggcctggaacaatattcctgagccagaggaggatcgagtttgactccaggcctaacacttactaggtctatgaccttgggtcagtaatttaaattctctgtatctcaacctctcaacagggtattggtagggattaaatgtgttagtgtctgtgaagtgcttagagcagtgcttggcatagtaaatgcttaatgaatttcagccactgtttttatttttagtactttccagctcccccaaaaagatactttttttagacttgtattaagacaataaaaagtttaatcagcatgcttcatacctaaatatgcttcactttatagcaaagtttacaagactaaaactgttttgttgtaattctctgagtctcatgtgtttattaatgattttttctgctgtttattcatctgaattctactcattcttcaagacctagctggaatcctgtttctagaaagactcttgcccataataataaacctgccctatctgagttcctaggtggtctgtacctcataatttggtaattaattgtatatgcacttatataacaaaacattattgtgtgtctttgctgtatcagattctaggctggaagttgtagatatgatgtttttgtctagaaaaatgttctagaatgtcctactcaggacagtctgttgactttaaagacacatttcctaaacagacacttcatgaggcagccccagcctgtacctgtgttcctggacctgatgatcaagtttgatttaagcctcaccacttactagctctgtgattttgggcaagttacttgaattctctgtgtgtagatagaacaatgttgagggaaatccctttcccccatccttgtgtttccacaagggaacttgcttcctaataagtaacactttcaggggaatattctaggcccttctcttatccccattacttgttctttctgtgaaaagaggagaggttaatctgatggatgaaatccttaatctttcatcttctggactgtagagcctgtgaaccaaagcaatggaccacttgcactgaaattgaggctgaccctgtattttgattcttatttggcaacttatttctattctgttcccaattcaaaatcccaaggggagaaggaagataattgattaccagaagtatgtaatggtggtaggaagttgaataaatggtaactttttaaaagttgcatgagatatagtccttatcccagagaagctaagtttgcttttctttcctctcatgtattttagtattatttctacaattagattgtaaaccctttaaaagcaagaatatttctacattttcttactcctgatagcacacagtagactgctgggcacatacatagtaggtggctctgtaggtacttgctaaatgattcaacatgtttttccctcatggaaaagaaagatttcagtattgttcttatcagctaggaaggcactctgaataggaaatcagttctaggcaggtatccataaatgggttatgatttccaacttacttgccccagaggctcgctaatgttgaactcttcatgggtactttgtcttgcttcatgagctatacatgctaaggggttagcagatcatataatcttttgatctacaaaatatgatctttattgaacaaaaacttgggccaaaggcctttctcctttgccaccttcctccctcttttcattctcttttttgggaatgccctttgtgcatgttagttacagcatgtaccacattgcactgtattgttggtttttgggtctaacccacccttaacactgcagtccccaagggcagaaattcagtctcattcattttgatgtcctcagtgcctgtgctcagagaatatctattatttgaaaaaatagtgcaaaagtaaattttaggagactacatcacactcatctaaactgcaagtttgacaagttgacatccaaaagaaaggctctcctaaataacctcgccacagaaatttgggtgacctttgtagctctggagaaagcagaggcaaaaatgaaacctaaaaattatttgtgggtttttaaaaaatgttttctcatggagtaaaggtctacagctgagttcttttcatatgagggaatgacagaaacacagctggttctgactttcagcttcaactgagcgaccagagctctgctggtgaaacaggaacttgtattgtgcccctgacgtgcaccttgaaggtgtcagctcattgtccctttgttcacataaatagttttttaagaattgtttttgatcttgtgagcctctaactaaatgattaaccatgcaaagttggccatttggggtaatactgaagcacttctcttgagggctattgacaggtgggaatgtgcccacctccttgggtctctggttttcatgtcatacttgcaaatcagtgacagtttaaacttggggcaatcacttagcaagtctattgagttaccaagttaattattcccactttgcatgaagcaaccttgaaaatgattttcctaaagcaaagtacatccaaactcagtaccttcttaataacctttgctgaatgaataaatgactaattcataaaaaatgtaacatatctttaattcttacttacgggcagtttaagcctcttgtgtaagaggaggcctcggcttgagataacataggatagtaagcctcctagagaaatttctatatggaaacatggtctgctatgaagctagaagtgagaggacattatatttgaccattatatttggcttcagagcttctcaacatggggcccaaagtcaaggtcccttgtttcattaagaggaggtccaggagtgcatgacacccatcagactactgagacccagctggaactaggcaccttgcacaggggccttgcctaatcaaaatagttcttattttttctgagttccaagtaactagtttcctaacccagtgtctggatagtagtgccaagtgggagtaccttcaatgaacttcctcatgaggttatttctagcctattggaatgtttcgttttaggagggtgaggaagggaagtcttgaatttttgtgcttagtttaatgttgtgatacagctttgaccatccgtttaatgggagatctgttttccagatgactatacatgtggaaaggagaagttttttgagtgttttttttaaccccttttaaagaatggtttttcatttagtctctacatttgggggtaaaaggtcctctagggagacttttcaaaagtatttgaagtttgcatctgatttcagaggtgagttggaggcctatctgtgtatgacagacacatgtctccaacaactatatgttcacaaggactaagagccatccttttgggtccatcattcaacattgatctcacattcgtgttcgtatcagtatctttacagtgcgctcccagttacatctccctaatttcccttagtaggcttcacagaatttgcagtgtatgcaatggcagatgaccacatgtggagtcatttaaccacatcttccactgcaagtcagcccgctcttgatgtctgtttatgtttagattccatcttttggaagatttcattcctctgcactatctcagtatctcagatgcttttgagactgggtccttttcccctcctatgtttggccatggccaccccctcagggttgtgttgtgtttcacagctgctgtttgtagggttgacctttacaatgtacaaagctctttcccatatgttgacaatccctggtgtgatgctgtgagttaggcagggtgtgtatacgtgtcctcatcatattacagtggtaaggcaacagggtttttgaatttgatcacccatgaatttgtctaatttgttggtaaaaaatggtcatgtatcagccgtttcacagggtcagcttaatagaaagtgggagttaggcaggaccagaattcaggacttcagcccccggtcccagggactattctctatacccaattgtcccaccttgaatcagtttcttctagggaaatatctccaaaactgagatggcacccacaggacttcttaattgtagtcattaccaggaaaaacaagcaaaggaactggtgtaaatctctgtttttggtgattggtggagatttggagattgtcttgtgtcaaaagtaaagccactagattaaatgttttgttaataaattggttatttttaatttaattatttgacagttaatttacattattcaaaaatcaaaataaaatttaaaagaagtttacactgaaaagtcttgccccacttataccctgctcacctcagtatcccccaatacataccatctataaggtgatcatttgtattagtttcttgtgaatccttgatagtgtgttttatatagatacaggtaaatatgagtatgtactattatttcccccccaccccaccctgttttttttttgagacggagtctcgctctgtcgcccaggctggagtgcagtggcacgatctcggctcaccgcaagctccaccattttcccccatttttaaaacaaaaggtagtagccatatatacactattttacaccttgttttatcacttactaatatataccagagagctttccatcattttgtacatatgcacctatatctgtcaattattcccagaagtggaattgctgggtcagcaggaaaaatcatgtataattttgataggtattgcctaattgtcctgcacagggcttgaattgtttgtactcccacctttagtgtatgagaagacctgtttctccatagcctcatcaaacagagtgtgtgagattagatgagaaataggaggtgagcagtcttttaccccatccgtagtttgcagtgggaacactgcacagttgcaagagctggtgcaggtatcagattagttccagtggaaacgctgcctcaccatggccatgggcttgcgccagctctagtgacacacacggaatggacccacgttgccacttgcagaatttcctgtagcagaaagttgaacatgcattcattattcatctaactagccatgctggatctaaagagcacaacagtgttttttagaaccaaaaagaaaattgtttcactacaacacactgtgtataaggctttcaatgctcttttctcagctattaacattattttcaggactgagttcaagagatgtatcccaaatcacagggatgtcttgctaagcttggaactttcatactcaagggatgcttttttgaggaatgattttacacttactcaacatttgtaattaaataattagtactttataagataaatttaaactgtccaagtacaatataaacattgaactatgatgcattattgctagactttttccttaaagttgccaagtggtttcctgcattaggcaaataggggatcatataaaaatgccatgatttacggcctagataacatctccaccatttgagcagcatatattccaggtcatccccacataactccttaccattctcattagaaaggttgattcttagtcttatttttctctgaggacagcaaaaaaaaaaatccccttcagttccactgcatagaaaagtgtggtaaatggagccgggcacagtggttatttaatttaaatggacaatattttttatagaattttgacagggccactgtataggggaaagtcactcctcttcccctttatagaagagttgcacctggacagttgcattgatgactgtatccagtctacacaagaggtcattcctgggcataagaatggactgccaaaatctagctgaaacaccattgacaaatagacattttcttttgttaataatacctgtgaaggctttcataacagacatttccagttttgttctcaggctccttgcagctgctcctctaaaagtgtgctctcttccaagagctgacaatggccagaagcaaggtgttctgtcttttgtgccatcatcatctaacttgccacacacatttgggatgtcagcctaggtataggttttgtatccactcagtatggcttgtgggtctggttgcctttgttattcatgctgagggcctctgggcatcagtttggtgtgagagaacccattccatgaccctccttcctttggctgttttgactcgatggctcttgttggcacagtctgtgagtgtctgatgctctatccatgccggaccatctgttctgctgtctctgtggtctgaagtcgttttctgaactattccttgataataaatttgagatgatcttgttctacctttcttttcaagtcacatcttagccccttagccacattcccgaagaacatgacaaatggatgggtcacaagtcacgtagcatagggtgtcagaccacgaggctttgaagggattctgttgggtgctaaaaagaaagattttgtgtcaccacgattttttttaaaggcatgttgacacttaggccttaattgaaagcgttcttactcaagtagagttgacagaggagtatttggtagtcgcggttgctggtctgaagagcatgtggttctgtttcaatgcccaatgagatcttctcacgggaaaatgttctgacatctcaaacaaatgaccttcatgcatagttttgacaaaataccctattaagtatgcatatatggttggtaccttgtggtaataattcaatactggaaacagagtagcaacaaagaaacattagggttatatttaacctctgtggaattagtgtgtaaacaaactgcttatcagaaatgctcatatggggctttgtttaaataaataagaaactggcatatagggtctgcaggatatttctgccaagtagacctccctcacattataagacaccacatctatgtctgaccccatatggaaagaggcatagcaagccagcactggttcatattccctctccaccacataatgggtatgtgatcttagggaatccaccgaaactctctgggcctcagtttcctcagctataaatggtggataatcaaattatttacctcaccattaataaatgttagctattattttttatcaagtttaatacaaagagaaacattttacttatttttccagctatccagagcatcttccaaaatcctatcaccaacaaatactgtattgtatttattatagcaactatgtaaaaatggagtccctgtcctatgcttagatgaaatatgttggtatttgagtttgcatgtcttctataggaatcagtgtttagtgaaaacgggtggagataaacagatgttttcacagtcctgttgttcacagtaccgccaaattgaatgtttccatataggtgcattctaatggcttaaatgatgcagatattttctggccagccatatggatcttttgtcatctaagatgttaatattttccttatattttatagtagttctggagtacagccagtttcttgaatagggtccacatggctcattatgcacagggcctggaaactgccttactcgtgctgttgaaatgaaccgtgacacttcagaagagctgggagctggggtagagcagtggctaggagaacatattcaattatatttcctcctgcattaagctacaagtaatgagcactttcctgtgctttacagttaagtaattaaaagaaattatagagtgggatgcaaaaataacccgaaggacaactggatgtgtggagccaccagttttctccatgagtgcacaaggttaatccttgttactactcagaatgctgagtttctacagaaagggttgcaggtccacacatgttttggcgtctacccacacgcttctgtatggcatgactgtgcatcccagaagaagggctgtgctgtgtacctccacgtttcagtggaatttaacaaactgatccctgaaaatggtttcataaaggtgagtaacagagagctaatagccttctcttgctaattttatctttcccccaagatttcttgataatagtttgaaaaggagtgttattctttggtctctagaggcaacttacctttccagtttcttccatcacctgttttcatctctcttgtttttttaaatttaatgctgtatgtatttcagaggataggatctaatctagtgcggtcccttcatcaggtgagaattattcatctcattttcattttagcccttctgaattaatgacattgaagcccggcagtttggtcctaagatgggtttaattatgtacagatactctttctataatggaaattgctcagataactaattaaccacaagaatacactgtctatggaaaatttcaggagcaccgtctgtggaaaaactgggaagggcatgctgtcaccacagctctggggtctattaaaagtgtggttatgcagcactggtgtctagtggggtgttggctctcaactgccagaattcccatagcatttcatggcagaaagtcaaggtgtccagcaatactctgaaagtgacctgttgattaaagtcgtcaattctgaagaaagagactgaaataagacaaatgggtcttaactttttttctctttctctctcttgtaaaaatgtgtgattgttctggcatgttcccaatccccacataatgccaacatcttttcttaaagggggattccctttatccttggatctgagaattattgcatgttctccctttagggacaatgaatgcagttgcatcacccttgcttttttttttttttttgtacacagcatgcttattcttggatgcagggacttgaaagacaaagccccacctggctttcacaacatctcctattagtaggtgtgccttgtgtgtaatttgaaggaggcggtcccttagctgtgtttacactgtacttttaaatgtggggctgaaggtagaatcaaccatacttaagatgccacctgggaaaatagggttctgtgtcatctcagccccacccatttgcaaatgacttaacagcagcactattagggttcctagtgtgagtcatttgcatttggactggtgaacttggtgacttcttggtgtttggaaacaaacaacctttgcagtctttcgtaaaaagcctgaacagtggaccagtctccagttctacttgcaaagctgcccccatcaaatccctcataatgttcaacttaaaaaatgttacacttttctctggaaatctaaccttttttccttttttaaaagccattttaagtacttcagtcttgaatcaaatgatcccaaatattggacaccaacctagaaattgggttacctcctgggaactttatcgaagaagagagattttggttggagagggggttttgatgtttgatacttatatttactattttaatatttcattgttgttgttgctgctgctgctgtattattttgcgagtttcgtttgtttaaatttcatggtatttggtaggagagagctggatctgttggtttcaggacaagtctagaaataagaaatctgccttgagtgagtgagttggttccctctgttgctatttcaccattaaggacgaaaggaactcacaaggaccagagacatctggctgaaagcaatactagtgtgactggacatctactacctgccatagttggtcatatcgtttccagtatgattctgattgagtgagtgatattaggctatgttcagggatcagggaggctaattatgcttatattgccttgtagcattttggtaagaattaatgattgtgtagatgtccagatttaggtcagcaatattctaaaagttctcattgaactaatcatgtttataagtagcctgtactttctatcataataacaatagtggaaaagctagttgacataaaaggagcccagattttacttaagtaaaaacacaaaagcaaagatattttcccacataaattacaaaagcaaagatattttcccacataaatgtccccataaaacaagttgaaccaaagaggaaagatgacaggtaaccgtatgacacgctaagaaagtatcataatacttaagttaacttcaaccttttatttccttatcctaagcagcctcttttctctttatcatttagtcctgtgcttctcaactttgataagtaaaaaagttattgcactaaataaatcttattgaaatgcaggatctgattgagtgggtggggtaggtggaatgagggtggggaagttgagattctgcatttcttagaagtttctactttatgttaaaatggctaatccatctcaacattgagaagtaaggtttcacttaatttcagcctgtgtaagtttatcccatatgtacatttcctaaaactctaatctcaggccccaggaatttctcctttagttaaaatatttttaggaataaatttgaattgcattaatacacaatttataaatttaacacaaaaaattatttgaagtttgagactttaggttgcatgaaatcaatttcatacttgaaaattttctataaattcaaaagtctgtgtatttaaatacaatttaaatacctgtgttacagtgacatttgtttttctgtctctctctccaccatttccagagtcatcatccctgtacagaaaaatttttcccacatgatttcaccataaattcattaaatatgatgcttacttgataatttctccaggttctttttttttttaattatactttaagttctagggtacatgtgcacaacctgcaggtttgttacatatgtatacatgtgccatgttggtgtgctgcacccattaactcgtcatttacattaggtatatctcctaatgctatccctcccccctacccctactccatgacaggtcccagtgtgtgatgttccccaccctgtgtccaagtgttctcattgttcagttcccacctatgagtgagaacatgcggtgtttggttttctgtccttgcgatagtttgctcagaatgatgtccttgctcactgatggacatttggttggctccaagtatttgctattgtaaatagtgccgcaataaacatacgtgtgcatgtgtctttatagtagcatgatttataatcctctgggtatatacccagtaatgggatggctggctcaaatggtatttctagttctagatcctagaggaatcgccacactgtcttccacaatgtttgaactagtttacagtcccatcaacagtgtaaaagtgttcctatttctctacatcctttccagcacctgttgtttccggactttaatgatcgccattctaactggtgtgagatggtatctcattgtggttttgatttgcatttctctgatggccagtgatgatgagcattttttcatgtgtcttttggctacataaatgtcttcttttgagaagtgtctgttcatatccttcacccactttttgatggggtcatttgattttttcttgtaaatttgtttaagttcttttagattctggatattagccctttgtcagatgggtagattgtaaaaattttctcccattccgtaggtttcctattcactctgatggtagtttcttttgctgtgcagaagctctttagtttaattagatcccatttgtcaattttggcttttgttgccattgcttttggtgttttagtcatgaagtccttgtccatgcctatgtcctgaatggtattgcctaggttttcttctagggtttttatggttttaggtctaacgtgtaagtctttaattcatcttgaattaatttttgtataaggtgtaaagaagggatccagtttcagctttctacatatggctagccagttttcccagcaccatttattaaatagagaatcctttccccatttcttgtttttgtcaggtttgtcaaagatcagatggttgtagatgtgtggtattgtttctgagggctctgttctgttccattggtctatatctctgttttggtaccagtaccatgctgttttggttactgtagccttgtaatatagtttgaagtcaggtagcgtgatgcctccagctttgttcttttggtttaggattgtcttggcgatgcgggctcttttttggttccatatgaactttaaagtagtttttttccaattctgtggagaaagtcattggtagcttgatggggatggcattgaatctataaattaccttgggtagtatggccattttcatgatattgattcttcctacccatgagaatggaatgttcttccatttgtttgcgtcctcttttatttccttgagcagtggtttgtagttctccttgaagaggtcttccacatcccttgtaagttggattcctaagtattttattctctttgaaacaattgtgaatgggagttcactcatgatttggctctctgtttgtctgttattggtgtataggaatgcttgtgatttttgcacattgattttgtatcctgagactttgctgaagttgcttatcagcttaaggagattttgggctgagatgatggggttttctaaatatacaatcatgtcatctgcaaacagagacaatttgacttcctctcttcctatttgaatatcctttatttctttctattgcctgattgccctggctagaacgtccaatactatgttgaataggagtggtgacagaggacatccttgttttgtgccagttttcaaagggaatgcttccagcttttgcccattcagtatgacattggctgtgggtttgtcgtgaatagctcttattattttgagatatgtcccatcaatacctagtttatttagagtttttagcacaaaggctgttgaattttgtcaaaggccttttctgcatctattgagataatcatggtttttgtctttgattctgtttatatgatggattatatttattgatttgcatatgttgaaccagccttgcatcccagggatgaagccaacttgatcatggtggataagctttttgatgttctgctggattcggtttgccagtattttactgaggatttttccatcgatcttcatcagggatattggcctgaaattctctttttttgttgtgtctctgtcaggctgtggtatcaggatgatgctggcctcataaaatgagttagggaggattccctctttttctattgattagaatagtttcagaatggtaccagctcctccttatacctctggtagaattcagctgtgaatccatctggtcctgatggatttttttggttggtaggctattaattattgcctcaatttcagagcctgttattggtctattaagagattcaacttcttcctggtttagtcctgggagggtgtgtgtgtccaggaatttataaatttcttttaggttttctagtttatttgcatagaagtgtttatagtgttctctgatggtagtttgtatttctgtgggattggtggtgatatcccctttatcaccttttattgcatctatttgattcttttctcttttcttctttattagtcttgctagtgatctatcaattttgttgatctttttaaaaaaccagctcctgggttcattgattttttgaaggagtttttctgtctctatctccttcagttctactctgatcttagttatttcttgtcttctgctagcttttgaatgtgtttgctcttgcttctctaaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcacttcgttaagtacccagtagtcactcaggagcaggttgctcagtttccatgtagttgagtggttctgagtgagtttcttaatcctgagttctagtttgaaagcactgtagtctgagaggcagtttgttataatttctgttcttttacatttgctgaggagtgctttacttccaactatgtagtcaatttttggaataagtgtgatgtggtgccgagaagaatgtatattctgttgatttggagtggagagttctgtagatgtctattaggtccgcttggtgcagagctgagttcaatttctggatatctttgttaattttctgtcttgttgatctgtctaatattgaccgtggggtgataaagtctcccattattattgtgtgggagtctaagtctctttgtaggtctctaaggacttgctttgtgaatctggtgctcctgtattaggtgcatatatttttaggatagttagctcttcttgttgaattgatccctttatcattatgtaatggccttctttgtctcttttgatctttgttggtttaaagtctgttttatcagagactaggattgcaactcctgcttttttttgctttccatttccttggtagatcttcctccatccctttattttgagcctatgtgcgtctctgcacatgagatgggtctgctgaatacagcacactgatgggtcttgactctttatccaatttgccagtccatgtcttttaactggagcatttagcccatttacatttaaggttaatattgttatgtgtgaatttgatcctgtcattatgatgttagctggttattttgctcgttagttgatgcagtttcttcctagcctcaatgatctttacaatttggcatgtttttgcagtggctggtactggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgaaagatgctgttagtctgatggacttccctttgtgggtaacctgccctttctctctcgctgcacttaatgttttttccttcatttcaactttggtgaatctgacaattatgtgtctttgagttactcttcttgaggagtatctttgcggcattctctgtatttcctgaatttgaatgctggcctgcctcactagattggggaagttctcctggataatatcctgcagagcgttttccaacttggttccattctccccatcactttcaggtacaccaatcagatgtagatttggtcttttcacatagtcccatatttcttggaggctttgttcatttctttttactcttttttctctaaacttctcttcttgcttcatttcattcatttgatcttcaatccctttcttccacttgattgaatcagctactgaagcttgtgcatgtgtcacatagttctcgtgccatggttttcagctccatcaggtcatttaaggtcttctctatgctgttttttctagttagccattcgtctaatgttttttcaaggtttttagcttctttgctaaaaggttcaaacatcctcctttagctcggaggagtttgttattactgatcatctgaagccttcttctctcaacttgtgaaagtcattctctgtccagctttgttccattgctggcgaggagctgcattcctttggaggagaagacgtgctctgatttttagaattttcagcttctctgctctggtttctccccatcttattggttttatctacctttggtctttgatgatggtgacgtacagatggggttttggtgtggatgttctttctctttgttagttttccttctaacagtcaggaccctcagctgcaggtctgttggagtttgctggaggtccactccagaccctgtttgcttgggtatcaccagcagaggctgcagaacagcaaatattgcagaacggcaaatgttgctccctgattgttcctctggaagcttcgtctcagaggggcacctggccgtatgaggtgtcagtcggcccctactgggaggtgcctcccagttaggctactcaggggtcaggaacccacttgaagaggcagactgtccattctcagatatcatattccatgctgggaggacccctactcttttcaaagctgtcagacagggacatttaagtctgcagaagtttctgctgtcttttgttcagctgtgccctgcccctagaggtggagtctacagaggcaggcaggcctccttgagctgcggtgggctccacccatttcgagcttcctggctgctttgtttacctactcaagtctcagcaatggtggacacccctcccccagcctcgctgctgctttgcagttcgatctcagactgctgtgctagcagtgagccaggctccgtgggcatgggaccctccgagccaggcctgggacataatctcctggtgtgccgtttgctaagaccattggaaaagcacagtattagggtggggagtgtcctgattttccaggtaccgtcagtcatggcttcccttggctaggaaagggaattccccaaccccttgtgcttcctgggtgaggtgatgccccaccctgctttggctcatgctccgtgggttgtacccactgtctgacaagccccagtgagatgaacccggtacctcagttggaaatgcagaaatcacccgtcttctgcatcactcacgctgggggctgtagactggagctgttcatatttggccatcttggaacctccctttccaagttctttattacagagtgggtcactgaaacttcatggaacaaattggaaattatcttcttaattaatgtcactgtctaccatgtatgggaatttggtaaatattatatggtttcaataacatagtagatagaacattgtcaaatctaaacttcagtgaattgtaacagatcccacctgaaattctaaagaaaacagaattctaattgaagaggttaaacttttacagggaatgtcaactgccatttgggtcctgtaaacaaaaaactgttttttaaaaaagtaaactttaaaagtattttcagatgacctcatttgctatccaagtggcttgagtatgcttgatgctaagacttctttgttacagactggagatgtgtgctactggggcagtgttgctctgtgacaaggaggcagaggatgagggcaaggttcgatgtgactgtgaattctgggtggctctggctatcgggagccttcattgattacagcaaaacagttgctttcctagggcaatagtgtctctgtcacccaggctggagttcagtggcatgatcaatcgctcactgtagcctcaacttcttagactcaagtaatcctcccacctcagcctcccaagtagctgaaactacaggtgtgcaccaccacacctaatttttttaatttttaagtttttgtagagacatggtctcactgtgttgcccaggttgatctcgaattcctgggctctagtgatcctcccgcctcggcctcccaaagtgttgggattacaaatgtgagccactgcacctggccctttgcaaccttcttgacaatgcattcctttattccctaactggaagtaacttctttctctttataaaattgtatctgtaccttttctgggtcatttctacctttatattctagttacgtatgtcctacctccctcctagggagggaggtaagtaagactggaaagtagacttcatgtgtgatgaatgaatgaacaaaaggaagtctaacatatggatatagtcaactggatgcaaattaaaaatttttaaatattgatttgcaagatttcattaaggtcaactcttaatagtttgtatcatatatgttaggaaccaaatattaataacttcttcagcattaccattatctttataggactgtctaaaatgagcagccatatctttaaactgtgttttctctgattacacgctcacaggtaaaacccaaaggggctgggaacaaacaagacttttttttttttctgtatgcctgaattatctgtactgttgcttgttttcccacctttggccatagaaacttagttctaacatgctacaatttttgcagttctttctcttagaaaaagaccacattgtctgaaatttcatccatttaagtaatcaagccttaaagttgaaggatcttggtcatgattaatctagacctacaaagtagtatcttaatggcactccttttagaaagttaggttccaggacacacatagctgcagtgtccacattttgtaagctccttcgttgtcacagccactctcttctctgtggctgatattctaaaactggcaacacatcctgatggtaaaagcttggttcaggagacaggtgacctactagctttatggcatttgacaggttacctaacctctctgacgcataattgcctcatctatataatggggataataatacccatcctgtctccttgtaaaaatcaaattagatgacgcctgtgaatgttctatagtctcttagacaaatgtaagttatgactacagcaagagtaaaagagcatgttgttatggacattctttcagtgaaatgtctaagacttgtgagtcacacttaaagctaaacttgatatctacttcattgattttctttttagttctatgtactatattgaatttcctgacagtggggctatgaaagccttcctagcattttatagatgtggttgaattaatggctgtaagccttaaagcagaattagacagcatcaatgaatttattaagtataaataaatatataatctgcttagcaatattacacagcctctttatcttatgtgtgataaagagtcatccgaaggttgaaaatgaagaattgtcctggaagctcttacttaatcttttattatttcctaatacagtatataaaattactcattgaaagcttagcagaataagaaacaagaagttaaaaggctgaaaactacaaattttgctattattattgttattacttcccaagtctcttattgatctgttagaaatagagctacacaggaaattgtaggacagttagtatgtggtagtgttatctgctttttaattattcaagtaaggttttattccattagaggaactcaagaagttggtcatggctgataattgctatctgtcaaattccttagagcagggatccgcaacacccaggccatggattgttaccagtccctggcctgttaggaaccaggctgcacagtaggaagtgagcggcgggtgagcaaacattgccatctgagctctgtctcctttcagatcagcagcagcattagattctcatagaagcatgagccctgttgtgaactgcacatgcaagggatctaggttgtgtgctccttatgagaatccaattccttatgataatttaactgatgatctaaggtggaaccatttcatcccaaaaccatccaccctgctactcccagaccgtggaaaaattgtcttccacaaaactggttcctgctgccaaaaaggttgggaccactgccttagagtttataatttggggttagcacagcctatatttacctgagaatttcaatgggttcactgatctttccaaatgaaaaggcttcttacgaaaattatatccaaactgtcttttctcttagtttaataaacctatcagtaagtttttactgagtactgctattacatttttctctgttaagcattatgggggctcagacatgatccattccctcaaagaacttacctttcagctgaagactgactagaatgagcaaatacggttaacaattaacaagtgagtaggccagctcggccaacatggtgaaaccctgtctctactaaaaatacaaaaattagccgggcatggtggtgggcgcctgtaatcccagctacctcctgctgaggcaggagaattgcttgaacccaggaggtggagattgcagtgagccgagattgcaccattgcactccagcctgggcgacagagcaagactctgtcttgggaaaaaaacaaaacaaaacaagtgagaagggaatcaagtactacgtaagatgtaatgtggaattttagggaaggaaggcagtgtatgctggagtaattagagaaaggggcatgcatgatttgatgcttgaactggatcatgaaggataagcaagattttggcagcaagtgagagggagagaggagtttgtcagaggaatggaacaagtcaggaggcagtaatgtgtacggcactccaaggactctgtcctgatcggagcagaagtgatgaagcattgagtagtttgagaaagttagctaagaagggtgagggcagatgttggagagagttgagtatcagagagaagacattagatttgagcagatagaacaaaaatgccattgccagtttttgtgtaagagaatagtattagggtggttacccaggaagtggtcatcagagttgaatggagcagaaagagtgtctgatacagcatcgggacgttgtggtcacaaaatgaggtggtgagggctgagccaagatggtggcagtgggatggataaaaagggatggccaggacaaatattttaaaggaaaaattaacaggacatctttactgactggattggaaggctatgcaggaaatatattgtcaaacttgattccaggatttctatcctatgcctgggttgcccaaaatatcagggaaccattgttagaaaaggtaggagataccactgttccaacaaaaagtattgagtttggtgttgcacccacttaacttcaaggccttacaagtgagtagacagttagttagaattgcagaagtgccactcagagagcagggcttgcaatgtggggttggactttgtcaccattgtgttaattcctaattctatgcagatgctcagcttgaggaatacccatgtttgggcttcagaatgaaagccaagtaatatttactcagatgccaattttccctctgaaatatttgctcatggaactgagagaacaatatataaagcattaattatttttctcataaagttattaataaaaagataagatcagtgaaaggcagagtaaactagaagccaagtatagaaaatggtatcattcaaagactcattactgtagtggtgaaaacaaaacaattttccaacagcttaagatgcctcagtattttggaccatttttaagtagttagtgtgggcacttagtaaatatgtattaaactatagttcattaattcttttttttttttttttgagatggagtttcactctggtcacccaggctgcatttttgctttcttagtgatatataaaatgtcgagtttcacaatgatggtatcttagatttgattaaatatggtattaaaaaatagctgatcacagaaagtctctaccagtgtgatgtagatggctaaagtattccacatttgcaaacttttattgacctaaataagaggtgccccttgggttgtttttatttggactgggaatattaggagaaagctttttcattcagtgtgtaagtacaatctaccagaaatagaaacccccatggacgatctatttctttgatggtacaggactcagaacattcacaaagatttagttgttagcggaatagacatctgtattttattcaaaccaattttcccttcctaatctgagaacattgtgcaatctaagcagttctaagcatgtttgctattcgtgcaaagtgagagtaaatctaaaagaaatttttttgtgtgtttagggatggtaataaagtctcttagtggttgaaaatgttatttcttacaaaagtggagaacatttgcttttcaataccagagttttcagccatttctgcattctgacctattgactggaggtaggttgcctttgaattcagtaaaacttcatgggcagaaacacagttccttttcctacttatttggatatcatgatggccattgcatgtatgtgtctttttgtaagtccatgcctcagaactgagaagtaggaataaaattagggtcagggctggggatgctactctttgctgctgagaaacacaatgcttcaggtaagtgattctgaagtccttcaccacctgacggtaaccttgggttggtccataggtatgttttcattttgcttgttcatccattttaattggcttcctagagcatgcttgtagatgtagagccaaatttagagtagagcaaccctctggcaaacaggaagagattaattttgtggtatgcttttaagggacttcccaggaaacttcaaaagcagaaaaagaagcactagctgcctattccaaaatgtgtaaaacaccactcagctttttaaaagtaggataaactcagagcgcgcgcacacgcgcgcgcgcacacacacacacacacacagagagaacatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatctttcttctttgctataatagagtatctctgtgggaagaggaaaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcaggtttatatgctagatcttgggggaaacactgcatgtctctggtttatattaaaccacatacagcacactactgacactgatttgtgtctggtgcagctggagtttatcaccaagacataaaaaaaccttgaccctgcagaatggcctggaattacaatcagatgggccacatggcatcccggtgaaagaaagccctaaccagttttctgtcttgtttctgctttctccctacagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcagcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataa

SEQ ID NO: 193495 - DNA, 3175 bp, Homo sapiens
  misc_feature (2)..(2): n is a, c, g, or t
  misc_feature (5)..(6): n is a, c, g, or t
  misc_feature (39)..(40): n is a, c, g, or t
  misc_feature (44)..(44): n is a, c, g, or t
  misc_feature (104)..(104): n is a, c, g, or t
  misc_feature (137)..(139): n is a, c, g, or t
  misc_feature (206)..(206): n is a, c, g, or t
  misc_feature (326)..(326): n is a, c, g, or t
cngcnnaaagatttcttcacagggtcctttaaactgtcnntttntaagaggtccttccactacaggtaaagggaaattccctctaccctagggcccctcaggancccttcctctctcacacgtttcttcgactgctnnngatttaagcattcagctggccacgcaacgcaagaagcaataagaacacaaaaaccctaccctgttcntcctctatccgtggcctttgccaccacctccacaacctagttcagattcctcttcttttctcaagggaacgtctaaagctctcaagtccgttttggcagggcgattttgtaagtctgaancatttcagtgtgtctctcgatctcaggcagctcaaaagaaaagatctgctggctgcgtgaaggtgcattagaaacctgctgctaccttgcagcctgggctgagcatatgctccggaacttgcttctcttccaacatcctgcacctcagggttgcacgctctggttcccaagcccccggccgctggcttatgcaaatcacttaggtacatgcaaaagtatcccttctcccggagcgccattggcccggggaggtctcgagctcattactatgcagagaggagagccgccattggccaagaggaggaccagaggggcgtgtttctcgggcaaattggatctcctaaattggatgacctgggctgaaagacaacttaaagacccccagaaaactctggttttatagataagaaatctgaggctcgagagagagtgtgttctgcccaacatcatcacggaacagctcctgggctcctggctcctaatctgtcatcgctgtctggaacagcgatgactcgatcgcgagatcaggaaggtggccgagtgtgtcgccgcggccatcaggcacttctccttcctgcccttgtatgaagaaggatgtgtttgcttccccttgtgccatgattgtaaatttcctgaggcctcctcagccctgcagaactggggttatagccatgtgactgatcttcgtccaagaatatgtaaagaaaaagtgttgagttggcttttagggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccagaaagagaagaggaggctccaaaggcacttgactactgagcatcaccctggacgtgtacaagtctgcgtccttattgttttcttcattgggccgaactttctggtcctcatccaacagctcttctatcacgtgttcgaaagtgtcagccaatgatgtcaagcatcttgaacctgccttgggcccattcacgctctccagagtcccatgggtccgcacacctggagatactctattatagcaaagaagaaagataatttcattgagccatcctgttttacagtattgaattattaccacaaggtaccaaccatatatgcatacttaatagggtattttgtcaaaactatgcatgaaggtcatttgtttgagatgtcagaacattttcccgtgagaagatctcattgggcattgaaacagaaccacatgctcttcagaccagcaaccgcgactaccaaatactcctctgtcaactctacttgagtaagaacgctttcaattaaggcctaagtgtcaacatgcctttaaaaaaaatcgtggtgacacaaaatctttctttttagcacccaacagaatcccttcaaagcctcgtggtctgacaccctatgctacgtgacttgtgacccatccatttgtcatgttcttcgggaatgtggctaaggggctaagatgtgacttgaaaagaaaggtagaacaagatcatctcaaatttattatcaaggaatagttcagaaaacgacttcagaccacagagacagcagaacagatggtccggcatggatagagcatcagacactcacagactgtgccaacaagagccatcgagtcaaaacagccaaaggaaggagggtcatggaatgggttctctcacaccaaactgatgcccagaggccctcagcatgaataacaaaggcaaccagacccacaagccatactgagtggatacaaaacctatacctaggctgacatcccaaatgtgtgtggcaagttagatgatgatggcacaaaagacagaacaccttgcttctggccattgtcagctcttggaagagagcacacttttagaggagcagctgcaaggagcctgagaacaaaactggaaatgtctgttatgaaagccttcacaggaaattctgcaagtggcaacgtgggtccattccgtgtgtgtcactagagctggcgcaagcccatggccatggtgaggcagcgtttccactggaactaatctgatacctgcaccaactcttgcaactgtgcagtgttcccactgcaaactacggatggggtaaaagactgctcacctcctatttctcatctaatctcacacactctgtttgatgaggctatggagaaacaggtcttctcatacactaaaggtgggagtacaaacaattcaagccctgtgcaggacaattaggcaatacctatcaaaattatacatgatttttcctgctgacccagcaattccacttttgggaataattgacagatataggtgcatatgtacaaaatgatggaaagctctctggtatatattagtaagtgataaaacaaggtgtgtgtatatatggctactaccttttgttttaaaaatgggggaaaatggtggagcttgcggtgagccgagatcgtgccactgcactccagcctgggcgacagagcgagactccgtctcaaaaaaaaaacagggtggggtgggggggaaataatagtacatactcatatttacctgtatctatataaaacacactatcaaggattcacaagaaactaatacaaatgatccccttatagatggtatgtattgggggatactgaggtgagcagggtataagtggggcaagacttttcagtgtaaacttcttttaaattttattttgatttttgaataatgtaaattaactgtcaaataattaaattaaaaataaccaatttattaacaaaaaaaaaaaaaaaaaaaata

SEQ ID NO: 193496 - DNA, 15 bp, Artificial Sequence
  Antisense oligonucleotide
cttgaattgtttgta

SEQ ID NO: 193497 - DNA, 15 bp, Artificial Sequence
  Antisense oligonucleotide
agttgcaagagttgg

SEQ ID NO: 193498 - DNA, 15 bp, Artificial Sequence
  Antisense oligonucleotide
atctgttctgctgtc

SEQ ID NO: 193499 - DNA, 15 bp, Artificial Sequence
  Antisense oligonucleotide
catattcttggacga

SEQ ID NO: 193500 - DNA, 15 bp, Artificial Sequence
  Antisense oligonucleotide
tgtgctgttgtaaga

SEQ ID NO: 193501 - DNA, 15 bp, Artificial Sequence
  Antisense oligonucleotide
tgacagaggagtatt

SEQ ID NO: 193502 - DNA, 25 bp, Artificial Sequence
  Assay sequence
gcacacctggagatactctattata

SEQ ID NO: 193503 - DNA, 25 bp, Artificial Sequence
  Assay Sequence
cctgcagaatggcctggaattacaa

SEQ ID NO: 193504 - DNA, 1532 bp, Homo sapiens
  ref <308>: DATABASE ACCESSION NUMBER: NM_003836
  ref <309>: DATABASE ENTRY DATE: 2010-02-28
  ref <313>: RELEVANT RESIDUES: (1)..(1532)
gagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaa

SEQ ID NO: 193505 - DNA, 8224 bp, Homo sapiens
gagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggtgagttccccggcggcccggctcgcgccccctctggggaagcctgcgactccccgccggccgcccggtgccccgcacgccccgtctcgtgagccccaactccgcccgtcccgcctagccctaagccccgcgctgtgcctgtctcgccctacccaccacgctcgcatgccaaggcccgtcccaggggtcccagggcgcaggggatgtgtgagacccccagccccttcccgccctgcagaagtggcgccagaggggtgtcggtgcgctgagcaaggaggtatggaaaaatggggtgctgttgtggagtcttctatgaaaatactctggggtgcaactttggggtgtccctgtgtgagcgttctggaacaggtctcggggcgggagtgggggacgactttgccgtcttagcccccaattcccagagaagcccagcctgagcccttcctgcgtggcgcgtttctgtaggtgaggggctgcgacacttctgtctgcagcggccatctgtctctgacagcgagagagttgcccccttcctgcagcgcccccccactcattgcaccagtggttgtaagggggctgtctagaaagctggggagctggttgagtaaatgcacacagtaggtgcctgttaaagtgtcagaatctctaagcagtgttgttgcaacctcagcccgctaagcaaaaccctgtgtcgtcatcgtttttttaatgcgaagagtctggggtaggggaaagagggaagatttgacctgggtgcccggcttaatagggatgaaccttaaaaagaatgcagacgccttactggggcgcccaccaggtgaacctgtctgggctttcccggagttgaacacctcaaaatctgctcctcttttcagctcaggttgcaaaagtgacggtcaggctgcatgcccagggctcaacatatttccctccacggtccccgtccccgctgttaggaggacttgaggtgtcgtatttgcttttgggagtccgaggagaaggtgtttctcctgctcctaagaacgagggagagtgtactgtggtcatttcattgctgggaacgtggcagagatgtttttcctgagtgcactgagccccatccatgctcggataggaagtgcctactgtgtgccaggctggtaggacccaagagggctgttggtgccctcgagggcagtggtgggctgtgtgggcgaagacagcctttgccttggcctggggcctggtggggtgaattgtataacctttcttgtacctcaggggctgaatgcttcccggcctgcaacccccaaaatggattctgcgaggatgacaatgtttgcaggtaatagagtggctcctcagaggcagcttgtaggggccacgcagaagcctggggagtcgtgaagtcaggcagaaaaaaatagggggcttggccactacgctgcagcaaacagcttccgggcccctgcagaaaactggtggggcgagctggggagatggggggggcggggggggggcagccacagctcctgtctgcgttctcagaggtgggggggcaggtgggaccactgcaggccactgcggcaaaacgcagcactcccccgggatctcggggcccctccaagtcggccccctcagcttggcatgttttctctttaagttttcccattcaggtggctggtgtttacttcccaggaccaccggctgccactgtgcaaagacccccaagggtccttggttccacagaaagtagcctgagctgcctctctacccctgccctcttcatatgtccccacctttctcccccacccattgcaggtgccagcctggctggcagggtcccctttgtgaccagtgcgtgacctctcccggctgccttcacggactctgtggagaacccgggcagtgcatttgcaccgacggctgggacggggagctctgtgatagaggttggcactcgcctttgttcacctcagctctgcgtccttacctgcctgccctagcccctaccacctcctcccagtctcctgttgctggtgttcctcacttcctcattcctgcacactccgtgccctgtattctaaagatctgtttataaatttcctgtgggtaccgaatgcctcctcagaggtagggactttattttgctcttctctgcgccatcagcacccagcacctagagggaacatggcgtgggggccagggagctgcctgttgaataaagagtcacaaaatacacatacagctgggccggtgggaccacagaccccaggctgcctgtccaggtcatggaagcccagtgatggacagggctctggggatctcagagctaagactccctagaaaagcacacgcaagactgtaaagaggctgcaaacaaacaaacggggtggggggtggccagcactgctcagtggttgaggggcaggtgctgagtcagggccaggaggacagggctggggggcctggactgagtgggtcaggtgtagggggaggctgcagttgggaaaagctgagaaagggttaaagtgaagatgggtgttatctgttgatttcattaatttatgcaatctttgcctccattaccccaagcaattgagagttggctgtcactgcattttcaggctgcgaaatgttcgtctaagcccattttcatttggcaaaaccagccctaacgtttgagcaaactgaagtccacaaaaaaactcccagctgtgtagcagcctgccctcagggcccctgtccctcagtccccaacattagtaaagacggtacagatagggaaactgaggatcagagaagcacaagtgtctgctaaggaatatgaaagaagttgggcaaaaagccagctacaaccctttcccccagccccagaaagagagttaatttttatcttcgattgcatctaacatccttccttaaggaacacctaagagcattttgttgtggcccctgccctgtacagccagggcagccgtggttctgaagctgagctccctcccaccccaaattgtctctggtccttaattccagcccctgcaatatggtgcaaggtttacccgcagctgactcatgctctggccagcatctctgctgcccctcacagaagcagcggcagcagctctgagtcgtttgaggatctgggggattccagcaaagccaccatttgggatcagggttaggcttttagcttggagcccatctttttggtatctaaatgccgtacacccttgctgaaattttccggacaaatgcctcccttctcatgggcccttggtatgtcccctccccaccaagttgacaaaggcagccagcttggggatggccagagagtctggggtcccagagaagacatagccctccctctccctttttgcccatctttgaggctgtcgtggccacagctgctgtcccagcagagacccccaagcagccttttcctcagagcagcttaattcacccctgtcttggggttggaggctcaggagggctgatccaggattggcatagcagggagagctgcagggacaagctgggggtggtcgccagctttttagcttaaatttaagattctgagtgacaggagagtcgggtgcagagaataaggagcctgacgcggaggcgccacgtgctaatgccttgccggtgccgtcccgtaaagataaatcctctttatgtgtccttgcaccaagccgggcttccatggaacaccacggggtagtccatcaacacaacgttcaggctcttcctccttgattgattgcagtctcccctccacgagggtgtgggtctctctgagagggggaaaaaatacgcacatgtgtggcctcagcacgggggatttcccctccccccaccccctccagcctgccttagcttgctgtgtctctcactggccctggctttctgtttggcaggtacagcagctcaaattatagaaaatcaaagctgaagagtccctcagagattggccagggaaagaccctctttttataagtagggaaactgaggcccagaatgggtaggagctgaactctgctgccacatggcagcaggccggatacagggcaggacaggggtcccttcctggccccactggggagctggggtctccatcatcagagagcccctgactcaggcccttgtgttcagctcatccctggcttgctgaacctgaataatgaagtgtgcgtgatggaaggtgttaaaagatggtgggaatataccagtgctcatggaaacctgtgctgataggagagcgctcaatagttctaatttccctggctttaaaagatgaagcctttttaccagggaccccttgagttcagagcctgagtgcagaaagagagaccacagggacacgtggtagtgctggggttaacaggtttcttgattcctgacggaggggggtcgttacatctccatcccccccactgcccctctttgatggaaaagtatgaagagctggtggtttttctgagggttgggctgtattcatcccccggctggccaggacccctcccctaacaggagagggtggagatgcagtcttgtctggtggagacaggccttagggaatctcagctaggcacgctgttgcagggaggggcatgatgtccacagtgaacgtcacggacatgtcgctggatatggggtgacctggtgccaggcaaagggaacagctatcctggcctgaatatcagtggccacgactttctgatctgtgaccttaggcaaggaaaccccttcagcttcctgagcctcagcttactcacttcatgggtttttttgagggggctccctaaaccctcttactccagaccccactcggtggccatagagccattttaaagcccactggggcccgcatcacgctcgtgtatggagaggaagctaagttctcgtcttccccgtcaccccgcagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacgggtaaatatccttcctgtgtgtgatctaatgaatgctgcttttcatgcggccaccaaagaccctttcagcctaaccctgctggacctgtcgtctgacaaaagatgaagtaagcgctcatcctggcagccccgtaggggaccgccctggatgggagtattcacgggggaatgtgtcattgccataattttttcaaatgatcctgaaggcgatttcatattcccctgatgttctcaagtcccgatgcgtgtgagtgacagtcgatcggaatgatgaactgacactcggagctgcgtaattttctaaaggcaacgtagtaaaagattggagctccgcggggctgaggctgtttgtgaaacccacttgctgtatctcagggggtggttttggggaactggtgggctctgcaattggattttctgggatgtctgtggagggagttgccaggctgagaggtgaagagattgggcttctgccagcacgagaggaggtgggccagctgtcggctatcctcagtggggaagggggctttgggactcctgggcagcggacataacagacagagtggccactgtcttcacttggacctccctgaacaatgcttcccagcagctcagcctctgcccacccattatctctttggcggccctgagccatccctccccgctggatggggcttagcctgaagccaagggagatcttgacagaggcagggtccgaatgtaagaatccaaacttgaacccagtcctgggcctgtagttggggggcaggggtgtccctttcctctgaagaaacagaagctaacatgcaaataagcttatcttgaccggacatcgcagggtggcacagagaccccagtagtctgtaagagctgtaaacagacattaacggggcttccaaagatcagtcttcagacggggtcagagtgggggctggtgaagactgaactccatttctgcttattagcaggaaggagaaaaacagagcgagacctttaaaatattttgcttttctcgcgaatggacttaaaccagtgtgtcaaaatagagcctaaggcccttgaaattccttcagagcccagctcccatgcagcccacaccctgaagcagcagtgctgatttcttgtgtttactgccccttcttccccggagttttgccatttatcggatgacaaagggctcgctcgtttaaaagcacttacattaaatgctccttgtactccactttgagcaaacagctttggtttgcaagctgcacttgggtgaatggaccactattaaacagcctggtacagacgctggcttgtgccaccgtagacagacctcgtattgctttctctttgagagtccccaagcgcttcctgcacaatagcctgtggatccacaccgctaataataataataataataatgagggttggcggcaacagtggacataggcatgaaggacgacagcgggtcccgggatagagtgaggggcgccccttgcttggttcttctgccccagcagtccagggatggagctaagggaagggggcttgctccagtcctgggctgtcactgacttttcctctcctagcctcagtttccccagttggctagtgactaaccggttggagactaacctctggttggagaggtgcagtaagaggtgggagaggacgtgggcatcctggcatgggaggtcgggtgtgtcccaggttagcatcgagatgggggtgaggtgggcacccacccacccacccccagagctactggtgagcttctcgcagacaggggtcacggccccgggcacctctctgtgcctccctggctggcgttccctccctcgctccctcattcacctgatgtgttttaagcacctgccccttagtcaggccagggaccttctgccctgagccccgtgccctgcagcgctgttgtagcctagcccctgaggccgtttactatgtccctgttgtgttgcagctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagtaagagaaataa

SEQ ID NO: 193506 - DNA, 1347 bp, Homo sapiens
gatgaaattcttattattattctgtatcatgcattaagagagagaaagaggattgtttttgcattgcgtttgtcacacagcagcacaaagacaatatatgtaagcgtagcgttcaccagatttgacacaagagatagcgaacaccacaaagattaggacagaccgcgtatagtaagctctgcggaactccaagaatctagagggggctgtgggaacgctgcttagatctcctcgtcgccggcctccttgctgaaggtggtcatgtcgatcttctcggggaagatgatgttgacggccaggtcctccccgctgttgtactgaagcagcaggttcttcttcttccgcagcatgtggttgtagcgcaggttggacacccaggtctcgcacttgttgaggaagacgatacccacagtgcccagcaccaccaggctggtgagcacgcccaggatggtgaagcagatggcctggccctcggtgaggagaggggttttcttgttgagctctttcatggacaccttcaggatgcggtgctccggctgctgcaccggcagctcgtgcaccccaggggtcaggcggtaggccagcccatagccgctgggcagacgggtgacctgctgggggctcagcgcgcgcttcttgacacaggtgagacctgtgaactcgggcttgcacagacactcgtagctcacctgggtgtgctgcaggcaggtgcccccgttctggcacgggctgctggcgcagttggtcaccgggcggctgcaggtcttgtcgatgaagccggctgggcaccggcagcggaagtcgcccccaatgtcagtgcagacgccgtcgttctcgcatgggttgggggtgcagctgttggccacgatctcgcagaaattgcctgagaagccaggggggcacaggcaggaggcatgggaggcccggccctcatcatccacgcaggtgcctccgtgctggcccgttgatcacacagggcccgtcctttttctggcagtcctttcccgagtacccgggggcacaggagcattcatagaggccatcgtccaggctcacgcaggtcctgttgttggcacagggggccgaggagcaggcccgaacatctctatcacagagctccccgtcccagccgtcggtgcaaatgcactgcccgggttctccacagagtccgtgaaggcagccgggagaggtcacgcactggtcacaaaggggaccctgccagccaggctggcacctgcaaacattgtcatcctcgcagaatccattttgggggttgcaggccgggaagcattcagccccataggtgctgtggccgaaagccagcaggagcaagaggacgcgcaggag

SEQ ID NO: 193507 - RNA, 27 nt, Artificial Sequence
  Antisense oligonucleotide
gccuccuugcugaagguggucaugucg

SEQ ID NO: 193508 - RNA, 27 nt, Artificial Sequence
  Antisense oligonucleotide
cugugggaacgcugcuuagaucuccuc

SEQ ID NO: 193509 - RNA, 25 nt, Artificial Sequence
  synthetic polynucleotide
acaugaccaccuucagcaaggaggc

SEQ ID NO: 193510 - RNA, 25 nt, Artificial Sequence
  synthetic polynucleotide
ggagaucuaagcagcguucccacag

SEQ ID NO: 193511 - DNA, 2884 bp, Homo sapiens
  ref <308>: DATABASE ACCESSION NUMBER: NM_006164
  ref <309>: DATABASE ENTRY DATE: 2010-08-04
  ref <313>: RELEVANT RESIDUES: (1)..(2884)
aaatcagggaggcgcagctcctacaccaacgcctttccggggctccgggtgtgtttgttccaactgtttaaactgtttcaaagcgtccgaactccagcgaccttcgcaaacaactctttatctcgcgggcgagagcgctgcccttatttgcgggggagggcaaactgaacgccggcaccggggagctaacggagacctcctctaggtcccccgcctgctgggaccccagctggcagtcccttcccgcccccggaccgcgagcttcttgcgtcagccccggcgcgggtgggggattttcggaagctcagcccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaattaaaaaaaaaaaaaaaaaaaaaaaaaaaaaaaa

SEQ ID NO: 193512 - DNA, 31261 bp, Homo sapiens
aagggacaggttggagctgttgatctgttgcgcaattgctattttccccagagcggctttgtctttggatttagcgtttcagaattgcaattccaaaatgtgtaagacgggatattctcttctgtgctgtcaagggtaagagttgcgagtgtagattagaatttctgttgcttttagtctgttagtaattttttgctttcagctattatttctcccctgagtactttatatatgtttccttttcagttgagaatttgcctcaatttcttaacatgttccccctcttctgcaggggcagagagtggaacgcttgcgtttcaaaacacttgctaatttctgtgaattgttataaaagtgaaaagaagtttctgctcatcctttgtagaaactttaaaagtagatatttatatttctaacttcttttgtaaatgaattttaggaaaaaaattggaattcaaggaaatgtgtacttgatgtacagtaaatacgtttatgctgttaaatgtaaagttttcggttaattccaaagatctattgtaaagttttaagttatggacaatgtattaattgtgcttttttccccctttaaagttgtttgtcttgaacttttccccagtcttcattgggattgtattcttctggttccaactagtgaagaattaaattgtaccttccgatttatttaatagctgctgttcaagagttatctataggaatgcttgtttgactgaaggatatatgataaaaatgaactttagtttttctgatttccggaattgtctacagccctctattatttttgaatttttctttctttgctgtgtaatataacattccttatacaaaaatgcgtgaaacatatgtaccgcattaagtgtgtattttccaattacgtttgataaaaataactgcttttctacctttgtaatcagacatcgatttgcatatttgaaaacagaaaaagaacaagaaaatttagaattgattttgtttatgattcatattagattgttgtcatccataaagatttgaacagagtcaaacattttcttgaccttttgtcaaaaaaaactctccaggtgtgaagtggtagtaggatatagtttttcaccttctgtgcagaggatgtgttgataaacagggcagtaaggagagccttagattcagtatctccattaggtggaaggaaccatccattactcttttcaagggtgtcttggagagataaagcactttcctagatgagggatgaagttgatattgaaatagaccgatgagattatttttaagtcaaacaaaagaaaaataggacaggcctctcatctcctgaatgaatgttaagcaaagaacaacttgactttttagatatgtgaaaaatctcttgagaggttgtggaagcagcatgtaggaggataaatgcataactcacatcagtcttttacgcattaaaaataacttgggccattttgaaatctttctttcttgccctgggttcttataagcaatgttggggggaaaactgactctgtctttaggattaccaggaaaagttgaaagccaaatgcatcatttttcttaatatttgtttttattgaggataaatcatgtttaacaaagctgcatgaaaaaaaggaacccaacaagtacatttttttttctgggaatttcctctgtcctgactgaagacatttaaagggggttttgtgtcaatatttcctccttaactgttcctcaagcctgggttaacttttcagtatgcaggaagaatttggcactaagataataatagataagttactgggcacgtccctgggtgccagacataattgcttcacatgcataattttacagtaacctcacgggaaatattattatccctggtttccaggttgggaaaaccaggcataatagttagatcaggcattaggttaggaaaggttaggagagaggcatagagaaaggccaggacctgctaaggtgaccatactattgagtggccaaggtagcattcaaacaggtttgactcctgggggcttctaatcaccacttccagactgtaccaaaactccttaaactctaaataggaagaaaagctcacactttaaaaagtgggtaagttgagatttgcctattctgggggaaggagaggccggaatataaaagattaatgtctgcagcttttccatttagcaagacatttaatcactgtatgtgacgtggggaggtggaccttgttaaatacagggagagtgaatacaatccatcaatggtacccactgtggtccttttaaggaagacacagaggcctcggtggattcaatttagaaaggcaggactgttttttgttttttgtttttttttttttttgagatgaagtcttgttctgttgcccaggctggaatgcagtggcctgatcttggctcactgcagcctctacttcccgggttcaagtgattctcctgcttcagcctcccgagtagctgggattataggcacccactgcccggctaatttttgtatttttagtagagatggggttttaccatgttggccaggctgggctggtctcgaactcctgacctcaggtgatccacccgcctcggcctcccaaagtgttgggattacaggtgtgagccactgcgccagtctgtttcttaatataataatagttttaaaaatttctgatgtttggcaatgtccaagattctgcctcacatttttcagaaactgccttttttcttaattaaatctcttagctactggagtctttgcctttgtttgccttgctacttggtacatttcttctgttccattggctctttttgttttgaagtagtgctcaaaaataagtttggtagtaagaatatggtgaagagtgtgacagacagggttaaaccaggctgaaggaaagagagcagaatggggaaaatttgagttgaaaacagctagcagaaagctgatggcgcaaattcaaccctaatctcatgttttggcacttctgaactatagcaagcataagggctcaactcttatctagttgaagcttacttgggtctttgagaatagtacatctcaaaattaaacactttcttagtccttattgttaagttgtttttggaattattgtcttatttgtctgaattaagtgtgctgcaggacttataggatctgatggatgatttgcctaaaagttggtccaggtcaacctcagggcatttaaatgcttggtccagccactttctgaaagttgactgaaatatgttgcacagcagggtagaggaggacaagtttactagatgtcatttttaacctgcttgtcttcatctctgactgtagaaatgtatattcattataagtttgccacaaatagagaatagagtttattctttgatcatctaatttctaggagctattgaaatttcactgctacctgcttttaaataagcgccaacaaacatttattaaaagggctttaaggtataggccaagatttattcaattgctaatggtatgttttctgtaaatgaaagcaaaaatatgttcaagtgtataatattaaatattaacattcagaaacttggagaaatacagatggcttttttttttgagacgcagtcttgctctgtcgcccaggctggagtgcagtggcatgatctccgctcactgcaagctccacctcccgggttcacgccattctcctgccccagcctcccgagtagctggtactacaggcacccgccaccacgcctggctaattttttgtatttttagtagagatggggtttcactgtgttagccaggatgatctcgatctcctgacctcatgatccgcctgcctcagcctcccaaagtgctgggattacaagcttaagccaccgcgcctggcctagatggatttcttgtaccagactataccctagacatgaaaacaagactgttaaacaaaatcctgtgctacctaaagtttgagccttctgtgtgtcagtttctgccataataaataactcttaactatgattattaagtatattaagaactttgagtaggggaggcacgtttaatcattcgtttttacggcatatgtactataatacctgtgtgttgcaaatcctggtatttaaaagtctttttgtgtatttgagcatgtaagtttatttggtccaaactgctggtactagtaaagacaagtccagggcataagtaggacttacagcaccaagttcgtcttttttttttgagacagagtctcagtcggtcacccaggctggagtgcattggtacagtctgggctcactgcaccctccacctcccgagttcaagcgattctcctgcctcagcctcccaagtagctgggattacaagtgtgtgccgccacgcccggttaatttttgtatttttagtagagatggagtttcactatgttggccaggctgatcccgacctcaggtgatgtgcccaccttggtctccgaaagtgctgggattataggcgtgagccactgcgcctgacctccaagtccatctttcaaaggctctgttgataattgactcttgagagtcattacagtccatcaacagcctgtattctgaatatttgtttttaattctaagacaatgctaaatagccattccaaataaggtgagaactgagactttagggcctgtattatcagctgtacactgacaagctctgaactctattgctttttcaaatcagagaagaaaaatgagtaagaaaagaaaaatatggatcacttaggctttgatgcctcctctgagtttatagtgtttaccttctgtattacttaggtgatcctctctaatggcattttaaatctctgttgatacttgtcttacttatgtatctgtttttttttcctctatagtagatagaatttatagatatatatgtattttaaagtaagatacaatttacgtaccttacaatttacccatttaatctaattcagggttatgcaaccctatgaatttagtagtttattcatagagttatgcaaccatcactgtaatcaattttcaacaccctcaaaagaaaccccatatccattagcagtcacttcccatttcccctcaactctcctggcccctggtaactactcagttattttctgtacctatggatttgcctattctggacatatcatgtaaatggaatagcatgtaaatggaatcatacagtatttatccttctgttgctggcttctttcacagcaatatgttttcaaggtttaaaaatgttgcaacgtatatcaatagcgtcattcctttttatggctgcatactattccattgtatggctataccacattttatttatccagttgatgatcatttgagttgtttccactttttatgtttctgtttgtttcttacagcagtggttctcaaactgttgtatattagactcaccatcagtatttaaaaaactaatgcccaggccatatccctcatgaaatcaaaatctctgggggtggggcccaggcatcactattttttaaagattctgaggggattctaacgagcagtcaggtttgagagccagtgccctagggcagcagtccacaacctttttagcaccagggactagttttgtggaagacagtttttccatagaaggaggtagaggatggtttcaggatgaaactgttccacctcagatcatcaggcattagattgtcctaaggagctggcaacctacatcccttgcatactcagtttacaacagggttccggcttctctgataaactaatgctgctgctaatctgacaggaggtggagctcaggcgggaatgctcgcctactgctcacctcctgctgtgcggcctggttcctaatgggccactgacccctccgcagccagcaggtggggacccctgccctaggggacccacctcagtgcttggtatccattgaagtatatagtgatttagaaaatctggttaggatgtcttatttaaatcatgaaagcaagtgcttttgtctttgatcattgcccttcacagccttacagttaacacctacattcaggaactgtgtttcaaagtgcctggcgagtgtttgaaactcactaaatatatataacctgggctcattaaacccctccagaagatttgggtaactttgttatgaaagggcttccctgaagtgggtcagcaggattgctctgtgttttttcaggaatgtggcctgtgataacttgcaatctagattatttggaaatagcactgagagaagccagtgaggacagaatgctcagaagcttgggataggtgttgaacatcctggaggccaggacggaacactgtcttactctaggaagctgtgttcctgggcctcattatcttcctccgttaaaaacaaaagacttaaatctccacagcagctttcagcaacttcattttttggttctctgtatctgcctgataaagtcccactttgtagtggctcccacttatatttacctgaatggcttttgggttgacatatttggaaactggggctaacttccaaactgttggcaacttgtgtgtgggtgtgcgtgccacagcacagcagtcccacttgagagacttgatggtgtggtggtggttggggggcttctgaagctggcttagccccagccctatacacccaccccacagatggtgggaacaagcccagaagagagtgggtaactctgtccactgtggcctccacagccaaggttgccaggcagagctcgcaaggcccaattccagtcttgtctttgaccgttgcccctttgtgttgggggggtgtatttagtcacctttctggaagcatgcttttctaattctagtcatcagtagtttgttgctttaagattttgaaaatggtatcctgttattttacttaggagtttcgtattgaatggtgtacataatgtgattcaagtacctcaaaacagaaggacttcagttaagatttaggctctatgcaacatacacttcttgcattttctcattcaatgtcctttcctttttttttttttttttttttgcaagaatgtagctgacattcagagtagattagtaccttcaatgtctgtgtgaaagaaatgaccttaatatgaggacaatattgactgtgtatttagggggcccactgttaaggcatatagaattttgctttatttcagacctgacaatctcttgtctgctctgcttccgcataaaattataatactgcacatggatgtaaaacccaacctattccctgcctgagggactagaatagagggaagaatgactatagttctttgttgccttttgtgaaggtaacaggcacagaggtatgatgcatgatggaattatatacctcttcttgaggtgtttgagggctgactaaggacctgtactttttttttggtttgttttgcagtactggggccagggagccttgctgttgtgtctagagagtgttgaagaaccatgaatatttcgcaaaaagaaaataatttttttaaccattaaaattcctggtagtgacttcctctggcaagtaaaaaactctcattttccttaaaaaatgagagttttttacttgcaataggaaaacttgccaatttttcaagttatttttattcttgatgattctcaatgagacataattaaaatacacatagaaaaaacaaccgtaggccaggtgcagtggctcacaccagtaatcccaacactttgggaagtcaaggtgggaggatcactagagaccaggagtttgagatgagcctgggcaacatattgagacactgtctcctcaaaaaattaaaaaaattagctggatccagtggtgcacacctgcaattgtagctatttgggaggctaaggtggaagaatagcttgagcccaggagtttgaaggtgcagtgagccataatcatgccactgtactccagcccaggcaacagagtaagatcatgtctcaatgaaaaaaagaaaaatcaaccctagtggactggaacagggctggtttactttgtgtcagctgcagtgcccccactcgccaacccacatgttcttctcctgctggttcccaagcagagaccagaaccaagaatgagaatcatcctgtgggtgcaggttgtatcttatcctccagagacagcacttcaccctctgttagaaacttctttaccacactgcctgtttggtgaaatccttagggcagtgacttccaaactgtgatccaggggccacccttggtgggaggatcaggaaggagggggaatgtatcttaagaaaagttgggggaagctcatatctcttctcgttgatcctgagaagtaaagtctttcctcctcagagagatgcgggtagacatgactcgcctagatagaagctcattcatctccctcccttctgcctctgcaggactcttggaagtctgggtccccgggagtatgcggctcttgctctgtgctacaggtttccaaagttcacttgataacagtacaattgtgctgtaaattgtgcagtaatggagactgaggaaacaattagtctttcatcttcattcatgttaccagctcacttcctatggtgtgaaaagagccagactttggagttaggagacatctgaatacagacagaactggcaagattatggggaagaaaagggaaaagtaatgaatattttcaaagaggttaagccatttggccaggacaacactgcttgcaggtagcagaactgggattttgactgtccataatccctattctctgcttgttttactccttccctctcttctttcttttttcattgtctaatgacctacagacattctgtcagctgctaaagaatgagggactcctttataaagattgataggacagtgtcgctacttaaggagttccttccatgtggaccagtgggggcgctgttgacgcatggggctggacttctctttggagcagagtcctgttccacggatcgctgtgacaagcagaaagtgccccaccccacctccatacaattcctaatgctcctgggtgatacaaccgccccagtggaagcacggtggtgcatggacttctagagaccatttgaagccaggacattgctgcttgttcttaggaaatggcagaatattactttcttgttttttgtagggaagcctgccatctcaccaggtggcagcttgtttataccttttatcctaacctgaagcaggtgatgggacagaggtcatcgaatataatgaaagtgccacaaaggtagagtctgggtatattttatttatgcaggtagagtgacttgtccagatcccttcacacagagcaacatttaatatggtaattgttactgctgaagttggccatttctcggacctacagctgcaaggaattggtaacaaaaggataaactaaacattgttactattttaattttcaaggagatgaagttaaaatcatatatgtcatatctctctggggcttagccaccttttctgctgggcactttttgaagaagtctgaatactgagataggagagtaaaggggggaaagtaagtttgcccacttctcatcctttttctgaccatcagcctgagggaagtaactagaatccgctaagaaaattcacttaatcagcagttgattgattgttatattgtccacattgcaaaattctttaaaggatatttgaagatattatcacatttgttctcttacaatctattgtattgtttatttgaaggggtgagtgttaatagttcttaagatatcgtactttatttccggtagcatatccaagaaataatttagaagtattgttaatgggaatgatgttaaataatttttctatgactagtagttgggacatatatgatataaaacatggtatctttgttacttaagtaatttgaactctaaccccatatatcttaggtagacaatgaaaatactgaattgttagtctaaataatatacacgtactcattccgcaaatatttattaggtatctacacaccctaggaatctttcagggcatgaagctgttttaatcttccaagataatgcagcacgtatcccccttgagggacatttgtttttcaaattgctcctctgtgtctcctctgcttaggatatgagttcctctaagactgtattttaatcttttgtgtaattctgatgtctagcgccatgcctggtgcttacgtaatagttgctcagtcagtttgagggtgagtccattaactgccctctaggagcttgatatttaatataaactagtctgtgatacatgacaatgctgtgacagtgcagatgagaaaatgtgacttctaactggggtgctcagagaggatatcctggaggaactgccattttaactagacttttcttttaagcaggtagattttgtttggttcaggcttcagctggaagcccaagcaatggtgcagatatgagctggactatgacagactattgggccagtggggctgacaaggttaacttgggggttgccatagagggccttcagtgctcatgtgcactgtttcaagtttgtacagggcatctggaaaccatggaagaagattctggaaagggcagggcaggtaaactggatgtggataggaagttactgtggcaggtgaattggaagatggacaggttggaggcagggagatggtgagcgggctcctgccaaggtgtaggtctgagcattgttgtgacggcttagttggtttgacatcagcacacagattgaggatctgtcattgtaactctaaattgtatccttgttagacatgtaaaaataactttttagagcctccgtttttaaggagggaagtggattgtgctcaagcttgcatgctccgctgttcctgtgctttaaaaatactcatccaccagtgtggtcactgatgaaaggggaggaaaaactagccagaagttgccattttgcttaaagaatggattcatttcttcctcaaggtggcacagagagagtttctctctttttgcccctctcttagattgatttactatttttagtaaattctaacagtctgatccttgcttccaattacaatgattagcaatatttgcccaagacaagaaaaaacaatttcctctcttttctctcctatgagcttttcctgtgagccccaagcagacagatgtggacatctagcaatgctgttaacaacagctgcagtccgttggactctctgcaacactgggcacggtacaaagtgctctgacaaactcttctgccctttgcaatccttactacgccctgtgaggtgaggagtattcttcctgttttgtaggtgaagaactgaggcaaagagaggttatgtcattagatttcacaatagggtgtgtttccgtttcatcatctttagattgatgttactgtgacatcatcttcctagaattaacaaagtgaactgggcacaggaaatagcacatggcacaccttcagcaaatggtggttgtgatcattttcatcattccatttcttcttgaaaaaaatccctttttttttttttttttgagacagagtctcactctgtcgcccaggctggactggtgtgatctcggctcactgcaagctccgcctcccgggttcacgccattcttctgcctcagcctcctgagtagctgggactacaggcacgggccaccacgcctggctaatttttttgtatttttagtagagacggagtttcaccgtgttagccaggatggtctcgaactcctgacctcgtgatccgcccacctcggcctcccaaagtgctgggattacaggcatgagccaccacgcctggcaaaaatccctcgagttccagtgtaaacactcacgcccttttttgctgtttgctataaacctctcattctccttggtcttcttgtccttgtgtgaggtcctggttgttgtggagactgaggtcttctgagacagaaaaccaaccccatagcaggcctggtgtgtgccctagaatggcagaggccccacacgttgccccggctcctctggaagaccctccagcctgtctgctggattccttgtacttatgaggattgttaaaccatctcataggattcctttccagactcagcccttcacttgtggcagcatttcttactctgaggttctgggcctagaaacccagtgtccataggcaaggtctagggacagagagagtttgtagaaagtgggaatgcatcagtggaaggctaaatccaaacaggaactgagctggcctgggtggctttgtccttttgccatcttcgtaaccctttaaaggctttaagacacttcttttgtaataactaccccaactaaatttggccagagctgtgaagggaaagaaaatctaagacccttgagggagatgacagccgaacgttttacatttttaccacctttgttgttgccatgcacagctgatacataaacaagtaatggcctcatcttctattcttttatttactggttagacccagaaccctaaaaggtagatgcttctcatggtcatttggcatttgcaacaggagctgaatttattaatagtactaatacctcatccttggacatccttgggttgtccgatatttttaaggggcatttacatcctttgtttttcatatggaaaacttttccgtaagggctggtatcatcttggccttccattgcaggaacagcacagggaggttcggtggctaggccacagttacccacgcagctaggtagcagcagaggccccacctggcaccccctggcttcctaagcacatcgcactgtgcagcctccctgaggaagcctcgagtggataggaactctggttctttaagataaacctgagttggatctcactgtcaccatttatcagatggggcgatgtcttcaggcaaaagtacttaacctctctgtttttgtttccttactccaaaatggtaatgatcatactactacccacctgggtggattggtgtgcatatgaaggaggtcatggggacaagtggttggaagagtgttgagcacatagaaagtacaagataaatggtggccattatgttactacttagactatatcatacttgtctttatctgggcttagaatcttgacactgagatctttcattctcagatcttaatatgaaagcttaccaggtaaacactaccccaacataattatttagtgggttcatacatgtgaaagcagttgaaatacaatttctgaactccgggttaatttatatccttagttggaacaggtagtaccctcccagcacctaaggcctctcacttctatccattcttcagatgacctttgcaataatcatggtaattgaatagcatctgcaccataacattgttgaataacatcaaaatgatccatttagccatcatgagccttcctagtaattcagactcacaccagttctttcaggttattgagtagcttttacaaataattgctaacagtacaaatactgtctcaggtattttggaagggtgaattttcccattgatttcagtgtatctttaggaggtaatttgcaaaaccgaagagtttggttccgtcaaagtcacccctaaggagtgtggaggaccacattgtaggtttatactgcactgtccctcatgcttgaaatttggctcatgcaaccaaggaactgaatttttaatttcgttaaattttgatttaaattttaaaacagaaatagtataaaatatttttctgttaaatataccttgtagtgttggcaagactacatttcgtgttaccatgctgggtaagatttcttgtagtgtgtattgtgttttgtcacctcgttaataattttcttattttggttgcatgttaaaataattttggatatattgggttaaataaatatattgttaaaattaaattcacttgtttatttttttgttggtgaggctaggctactaaaaaatttaaaattacccatgtggattgcattatatttctattagtgctgctttagctgcaagtagcctatttaaaaaaaatcattattttcagacttatggacttcatagaatcagaggtatttagaggaaaggatcttgggggtcacctaatccagctccaacattttgcaagtgataagaccaaggccagaggctacaataaaatgactgacctcctcccagatggggactggatcccagtggctttatagcctttgccttggatcctggttttacttggaaacatagcagacatcagagctgcagagaacttctaccagatccggagtgaagaaaatgccttatttatttatttatttatttatttatttatggagaccgggtattgctgtggcctaggctgtagtatagtggcagaaacatggttcactgcagcctcaacctcctgggctccaggatcctcatgcctcaaccttctgagtagccggggccacaggtacgcgccaccacgcctggctatttttttttttctcttttgtagagactgcgtcttccatgttggccaggctgatatcaaaactcctgggctcaagtggtcctcctaccttggtcccccaaagtgctgggataacaggtgtgagccatcatgcctgttttggcagtttttaggggcccacgctaattttgagccaggtttgcgcttgataatgtaatgctggaggctgggcaggggacatgatctgcctgaaagggctgagaactgggaggctcttattcctatagtattgagagcaaaggcacagtcttacagaaccacacaatattcagagcttgtgggttggagaaggaaagtcctctgaaaaataaaaaaaagagtacagaggccagaggcggtggctcatgcctgtaatgccagcactttgggaggcccaggcaggcggatcacctaaggtgaggagatcgagaccagcctgaccaacatggagaaaccctgtctctactaaaaatgcaaaattggccaggcatggtggcgcatgcctgtaatccaagctacttgggaggctgaggcaagagaatcgcttgaacccgggaggcggcggttgcggtgagctgagatcacgccattgcactccagcctgggcaacaagagtgaaactctgtctcaaaaaaaaaagaaacagagtacaggtcagacattgggcaattttctcataacaatttcataggccattaatttggttacagacttgaatagcacacaacagttctctaagggtcagtttccaaagtaattcctaatatttaatgaatttttaagtgatagaaattgcagtaggaaagtctagcttgaaatctaatttgtgttaggttgaccaggtgacaaccacccacccctggattctgctcagttaggtcagacctggggccagttgcccatttagcatctcaggcctcaggatcctcatttataaacctggggtttgaactgcggtctccacgatcactgtcagctctccttagtcagttggttgttctaaatgtagtttagtggccagtaaacacctgttcctgagtgatacatctttaaggagccggtagatgggtcaacctggctggacttgctttttcaagtctgccttgtctattagaaaggctgagcttactgattttgcctgtcacgtttgagtgttcctgagactttgcccagcctcggtcttatctgcgggtaccccagcctctgcattccttgcccctacaaaatgtgctgccagttccaaaggcacaaatgaaaattagcttggctggagcatggctaggcacacaccagtggttaaagaaatgctgtttgctggctgacacttctggagtggaagtttattcttttttcttttttttttttttttttgcggggtggggcagagttttgctcttgttgcccaggttggagtgcaatggcacgatctcggcttggagcgatcttgggtcaccataacctccgcctcctgggttcaagcgattctcttgcctcagcctctggagtagctgagattataggctcccgctaccacgcccggctaattttttgtatttttagtagagacagggtttcaccatgttggccaggctggtcttgaactcctgaccttacgatccacctgcctcggcctcccaaagtgctgggattacaggcttgagccacggcgcccggcctttattcctttctttggcctcaattttattgttaagagatagtgggaagggcccaattttgaaatgatcctggaattaatgtaggaggccttgtataagcagttaatgtgtatttattgagtgggtaccctgtgccaatatgatacaaggtgtgaaggacacatgagttgggaaaggcatggggaaatgcacgctcacactgctggtgcgagtgtaaaaggtacagtctctatgtagggctatttggcagtatatactctttgacccagcaactccacttttaagtatttatcttagggataccctcacacatttatgaaatgatttatatacaaggatattcattatagcaatatttgtaatggcaaaaagaaacaaaagtcagatgggggactgattaaataattatgttattaagtaatactgtttcagtacatctgtgtaatgaaataatgtccagtcattaaaaatagtgaggcaaagtctgggtgcagtggctcacgcctgtaatcccagcaccttgggaggctgaagccggaggattgcttgagaccagcctgggcaacatagtgagaccctgtctgtacaaaaaaaaaaaaaaaaaagtaaaatattagccaggcatagtggcacatgcctgtaatctcagctattcaggaggctgaggtgggaagattgcttgagcccaggaggttgaggctgcagtgagctgtgattctgccactgcactccagcctgggcaacagaacaagaccctatcttagaaaaaaagaaaaaaaagaaaaagggacaacttacaactctgtgccctgatgtagaaccatctccaaaatatattaaatgagtgtgggatactatgcttatatgcgattgtgtgtatttaatggcttcctaagaaaacaaaaaaaaacctgatactagtgattgccttggaggagggtaactgggaaattacttttgcaacttttaaatcttataccatgtacacctggtatctatttttaaaaagccattttcatgccctaaatgagtttagtcagaccatagtaagaaaatcctgtaagacatacaaagtatggggtaattactggctttatgggaagactgatttcaatgcaaaactctccctatgcaagggagttgtcctgatttcaatgctaagctctctttaggcaagttacgttggcctgatttgcctgttaagtcgtatggggcaggcaagtctgagtgtccagagggcagacctttaactcttagtttcctgccttgggagaaggcacagggctaaagtggtttccagaacgtgtctgttgtggtgtgaacaccaaggagcagtggacaagcttcccaggctcaaggtcagaaggtctggactggagtcctgcctctgctacttggtgaatatgtgatttggggcaggttgcttaatccccgaagcctcaacgtgttcatctagaaatgaagattacaggctggacgcagtggctcatgcctgtaatcccagcactttgggaggctgaggcaggcagatcatctgaggtcaggagttcgagaccagcttggccaacatggcaaaaccccatccctactaaaaatacaaaaattagctgggcatggtggcaggtgcctgtaatcccaactactcgggaggctgaggcaggagaatcacttcaacccaggaggtggaggttgcagtgagctgagattgtgccactgcactccagcctaggcaacagagtgagactctgtctcaaaaaaaaaaaagactacaatacctggcccaactccctcatgctactgtagtgaggctcaaatgagatagcacccatgaacactcctgtaaaccatgaagtatgcaaacaccaggtgtaatagaagctgttaggtacctgtgaggccagcagacaagagcaagagatgctaatttaaaaagaattaaggtgaagcaaagatcttttccctctgccaaataacttggcaagagttgtaaaattagaaaagtagacccttagtagtttgataatcctttgacctctgaccctgcacaaatgatctcaccctttagacctgttcccttatttgcaaaacaagaggggctgtctgggtgattcctgtggtcccttccagttgtagcgttccgtgacagtgtggcattaacagtaattcccatcttggctgagatggatgagtcatactaactgaaaagtcaaaatacgaggaagaagtctctttatgtatgagaattttccttgagctagagactcagagcctcttggggaggagatgagggaaaacattgccaccaccaagaagggagacgaaggatgtataaagagaatggagatgtatttacttttttttttttttttttttttttgagacagagtctcactctgtccttctggctggagtgcagtggcacgatcttgggttactgcaatctccacctcccaggttcacgccattctcctgcctcagcctcccaagtagctgggacacaggcgcccaccaccacgcccagctaattttttgtgtttttagtagagatggggtttcaccgttagccaggatggtctccatctcctgacctcgtgatccgcccgcctcggcctcccaaagtgctgggattacaggcgtgtgccaccgcacccagccgagattatttacttcttgtgtgttcttgccatctccatagcctcctttgctttcaaatgcccacttgggctgggcctttggaaaatagatttaacccttgtttattggaaggatattcacacagtaggccagttatacactttgtggcagtcgttacctcttctgtgaggtctttctgtgcagatttagtggcacctcctccatgctgcctgggcttctacttgcttctcatcactttgtctcataactcagatcagagactgtgtcttactcatctttgtatccctggcatctgagggggtggtatctgatgggtagatggattagtgatccacttagggtatttacactaatcttgttgatcttgactactacctttataaccaccaccattctacaagttttaacttttttttttttttgagacagagttttgctcttgtcacccaggctggagtgcaatggcgcgatcttggctcactgcaacctctgcctccccgggttcaagcgattctcctgcctcagcctcccgagtagctgggactacaggcacccgccaccatgcctggctaatttttttgtatttttagtagagacggggtttcaccgtgttagccaggatggtctcaatctcctgatcctgtgatccacctacctcagcctcctaaagtgctgggattacaggcgtgagccaccgcacccagcaaggatctttttttttttttttaaagctaagtgttttatacatataataatattgttaataaaatgtatctaaaattcataccaccagcacacaaggtctccggctagcagcagtaaatggcatttagtacttacttagcccccaagcctggatgactgactatactgacttattattacttttagctatttgtaggtagttacatctgaaaattgaccaggcacagtggttcatgcctgtaatctcagcactttgggagaccaaggcaggaggatcagttggggccaagaatttgagaccagcatgagtaacatagcaagaaccatctctacaaaaaataaaaattaaccaggcatggtgatgcatgctacttgggaggccaaggtgggaggatcacttgagcctgggaattagaagctgcagtgagctaggaaggtgccactgcactccagcctgggcaacagagcaagactcttaatctcttttaaaaaaaaaatctgaaaaggaccccaaggattgaactttatctttacatttatctttacaaatccaggatcaaaagagagggtaaaggatcacttggggagtttagaagtggcagaagtatctgtagaagccttacggtgtgaatgtgctggattgtgtgtgcccaccctcatgggggacttccttggaggatgagggtacaccagcatgggcagcaaagctgtttgacctcaaggtggagatctgagccacctggtcagtccatgcccagttaatttctatggaggtttggtaaagtaggttagggagttggatccaatgttcctgaagtttctgttggtaatatggcaggggtcgggtcgggtgtggggagggttggatcattctaagggcagtacaagacctaatcccaaaggtgagaagttcctctctgtggaggacagcatttagaactcaatacatacatggcttgttcaaaaatggggaagagattagaaaaatttatcctaatgtttgcttgtcaaaccaagccattctctcagcaaagtagtgaaacccttacataagtcctttgaagcctagcagcagtatcctactcaaacacaaaccaccaaaaaaaaaacaaaaaaaaaacaaaacctccttggggactcagatgtgaacctctcatggaaaattcagtaccatgtgctttttgtagcaggtaggatcacctgctgttttggaaattaactttttttctgacatctttttgaccgaactctgcatgtgcctcttgagaaaataatccaaattcttgctttcttcactttccagttttgctttatctttgcatcatgctctgcagtttacagacaagcataatgggtgagagttccagtaaattggctggatcatatttcttagattgagtcatgactgaggaacttgtttgggaacaggaagcagcccatgaaaatggctgcacatagtaacctgccagattgaagaaaccggaccactttctagtggaaagataaaagggcagaaaaatggttctataactcagggaatggtaaatttgtgaactagggttttaacttgttgaataatacgtctttgtgtgtatttgggcttttttatgctgttaaaagtctctagttattcaagataagggaaaggaaaacttggattcgtggtaactgttgctacctcttaaatgtctctgctgatgtatacaacatgttgctaggccagttattttttttaaggcactgtagttacatagaaataaacctggcaacatttacacttggcctcgataggctgtaaggccccttttgtctccagtattctgtgtttctgtattttaatcacctactttacacttactgtagcaacacaatcaagatagcaaatcagtctaataaaaccaaaagtactggaatgtgggaaatagaaagaatgacctagaattcttgctgagaaaacaattggtattgctatattcttgtaatgcagtgtgagagaagccagagaagtaaataggcagatacatatctatgaaatgtaattagtcatcagcaagatgtattttaaaaacacatctgcttggtgtcattttgctttatctaataaggattacgactgcaaggcagagatttgtaaatgaaggagatctctgttgtttttgttttgtttttgcttttgttttgttttaagacagggctggagggcagtacatgatcatggctcactgcaaccttcatctcctgggctcaagtgatcctcccacatcagtttcccaagtagctgggactacagcagtgtctcaccatgtctggctaatttttaaatttttttgtagagttgaggcctgtgttgcccaggctggtctcaaactcctgggctcaagtgattctcacacctcagcctcccaaagagctgggattacaggtgtgagccaccgtgcctggctgttattttatcaattcctcaaaattcaagcatgccctcaaatatttttgcagcctcatatagctcttaatttggtttatattcatccagatggtaggatatgattcatgttccacctggttttcttcagaaatacttagacagtgtctatggaaaaaaacattgaaccagatttagcttttaggtaaataatataatcacctgggaataatatgaagaatgaaatgaaagaaagaaaaatataatcaagtgtaacttagactctgaatgctggtaactaagatttggatgaaggaaggatctcaggggaataacattaaaataagattttttttaaatggaaatacatgattttaagaaggaataacttaagacattccaactttatactacatgaaagtaaaaagatcaaggatcagttttctctttggagcaaggctcagtttcgctttctgttgagagttagtagtgtgtataattaattttttttaacagtttattgatgaaatttatttttagaaggaaatctcccaccaccttcctgtcattctcagggcaagatagagggtaggagagggaagggagactcgggggaatgggaggtgcaagccttaattagacatttgagtgtctaaaagattacttttcatttcaaatactttgtctcagtttactgaatagctttaatttaggacagggattgtattatctttgctttatcttttccaatattttggatcatctaagcatgatagatgctggtttattcaaggcactaaaattgacttgcaaaagacatatttaatatggattctgtgttcaagtcctttcttctttgtttatcctggtacaaagatgtttgttttaaagtggtatgagttaattgtccaacttcagatttccctaaaatgtgtaacagattacccagttggcaaatgatgatatatattttttaaacatgaatatttctgttaggccagatggtgatttaacatgaattgtccaacatttgtgtttcttatcaaattgtcttcttttgtctaagccaagctagcaacataatttggaacacactcaggaatcactaaaggacaagagcaaaaaaaattcagacaccaagtggcagacggcatttgctccatatgccatgcaaaggctcctggccagtgctcgcatggcccttgggaagctttctcacccgttgtaagaaagtatctgtgcagtgctgtgcaacccatctacctgctttcctctctctacccaaaccctacttatctaacactttgtactgtggccttcctccatgggggacttgcacttcctcaaagccctggatttctgtgcagaagagcagttttagttcttccttaggcacttccctttcctcctgtccagtgtcatgttcttgtttgttatgggctccacccagacgattatttcctcttagatgatgtgtgagccttgcagagagctgggtcatttgtggaataaatcatgtgcccagtcacacggctccttacaggaaatggttggtgcatattagcttagcacaaaatacagtagtgagcttgtggtccccaacagtgagtcttcagttaacttctgctgtttttttttttttttttttaacataaagctttgaatgtttcatacagtatcaaatctctgcaggattttgcctgctgaaacagatgtgaaaatctgagtagcacagagtatgacattaaggccataacaataaacctattgttgctgcattctaaatttgatcaagatgtctgtttttgggaatccaaaatagttgcttcaaatttagcttttttcttttatgaagcagttttgttttgttttgttttgagacctctcatagcaagaaaaaacattacataaacttttttttgagacaaggtctcactttgttacccaggctggagtgcagtggcacgatcttggctcactgcagcctcgacctcctgggctcaagcagtcctcccaccttagtcccccacgtagctgggactacaggcacatgccaccacgcccggctaatttttgtatttttagtagagacagggtttcaccatgttgcccaggctggtctcgaactcctgagcacaagcgatctgcccgcctcggcctcccaaagtgctaagattataggcgtgagccaccatgcctggccacataaatataaacttaaaaatacacaggaaaacctttcagaacactttgaaacctattttggtcctattacgattgcactgaatgtcccccagcctaatgaagagcaattagatgtcatttggtggcattcttggtggagacagtaagctagggccgcaggagctgcttagtctcccagggtccagcattgtttcaggtaacgtgaacaggatgctcaagagctagtctaaataatgcttcatgtcttatttttcctgtttgttgataaggattcataaagatgtctttttctggtcatgtcaagggaaattcaaataaaaaacattgaattggtttggagctgtccattgaagggtactcacagcaggaattgagtggcaattgaatgtgtgtgtgtgtatgtttgtaaacatttatattagagtgtatgcaaatgtatatgggcgtgcccactgccatcaccattacccccaccaacagtaacaaaaccaccatcaagagcaatatccactaaaacttctaatttgcttattaatttgctttattatttgtaaataattcagaatctctgagatcaaaatccttttttattacaacatgttaatagtagtctaattcagacctgccctgaggaagaaccaagcaatgaagctgtccatgattttagaagttaattggctcattctttctgaccatctaggtagtcccaacattattttaggctccccctagttaggtccacaacctcattattatccattggcctggactttggtctcgcttatacagcaagtagtagagcctatcactgtcaacatgtaaacatttgcatattttacatttatagagagatacttttcacgtgcctcatttgatccactaacatctgtatgcttgggtaggatggaataattaaacaatgtatagctaaagccatccaaacccctcaaatattatcatctgatgggaaggaaaagggggggaaaggaaattaaatagttatttcaattcttggcatgattgacactgacaattataaattccattcaatattttcttccagctcatgagggttggttgtaaggatactttgcaagtcagatttatgagcagaagatgtttgcaacctaaattgcttcagttgcatgaaaaagtcacaaccttttactgatttttatcctgggatctccttaacaagaaaaaacctcaggcccaggaagtctagggtgaggcagggatgtgtcaaagtacacttttccccacgtacagggacaagtatttgagtttctttgattgactttgcaaagagctttgcacactttgcacatcacttcttgagatgggtgggaacatggactgcctattttacagagttcaattaagatcgcaggatcatgcattcctttcatttttggtgctagtacctagaagatgggaacatattgaacacttaataccttgcttgggcagatagctccagtttgcagaaagtctagacaggataccctgctatgtatctagatttactgagaagaagcggcccaagctaatcagaattttaaagtaggtttctcagctgggcgtggtggctcacacctgtaatcccagcactttgggaggccgaggcaggcagatcacttgaggtcaggggttcgagaccagcctggccaacatggcgaaatcctgtctctactaaaaatagaaaaattagccgggcatggtggcacgcacctgtaatcccagctattcaggaggctgaggtgagagaactgcttgaaccctggaggcggaagttgcagtgagctgagattgtgccactgcactccagcctgggcgacagagcgagactccgtctcaaaaaaaaataaaataaagtaggtttctctatacctttgaattttctgtctcccatgataacctttgggtaaacatgtccatcagaatggaaacaaatcattttttaaaatagaaattattctcatacctattttagtgggaatccccctgagaagatagccatgtatagtcgactgaatgctctgtggttgctattttgttgctcttggccaggaaactgatctaggtgacctacagacttaatctgacctgcagactggccgcttcatactaccaagattccaaagccaagtgtatatacagtcggcccatgcagcctctggttccatgatgcaaccaatggcagattggttcaaaaatatttggaaaaaggccaagcacagtggagtggttcatgcctgtaatcctagcactttgggaagctgaggcaggaaaatcaatggagcccgggaattcaagaccagcctgggcaaaatggcaagacgccatctctacaaaaagtaattagctgggcttggtggcatgtgcctgtagtcccagctacttgggaggctgaggtgggaggatcacttgagcccaggtgaaggctgcagtgagccatgattgcatcaccacactccagcctgggtgacagagtgagaccctatctcaaaatgagtaaataaataataaaatttcaaaaggaaaaaagtggaaaaaaaacccgaaaaaataacaatacacacataaaatacagtataacaactatttacacagcatttacactttactaggtattgtaagtaatccagggatgagttaaagtatataaagggatatgcataggttatttgcagcaaatgccatgccattttataatagtgtaggctcatggctaataaagcatgaacccgactgaagctgcctgggtatgtgtctttgttcagccactttctggtagtatcttttttcttaacctcagtattcttatactgtataacaggaatgttttctctgtataaggctgttttgaggaatagtttctatatgtaaagtacttagaacagtgcatagcatataggaagcccttaatagatactggcttaaagataattaggtatgtcctagtgaggtatacctaactacaagtgctactttaactatgcctactttgtgtgctttacaatatatattgttcaaggctagaataatgagccccatgagcagggtttcatagcatttaagattccaacgccaaccttcaatcatggacacaggtggcctgtgccatctagctagctgcgctgcctccaggctgggtggcctgctcctctgttggataaaaatagcctgactcctcactgaaacaaccaccatgttatttgcgtccttgggaagctgaaagtaatagaactctaagtctggcgttgccagctgtcagcagaatgaaatgcaaagtgtgacgtgtctacactgtacccactggccttcaagtcccaactcccgttcccccatcttgatttttttccattctcaaattaattatttcccctataggtgatttgtggaatggaaacagatttagatttcctacctatttagatttttccaaagactaaaattacaaatcagaaaaactgctattgacacatttttggttaggaaaatctggatgtggttcctatgcctagcctagtcatataaattctctccccatgtatctttttgtgtgtgtgaaacagggtcttgtcacccaagctggagtgcagtggtacaatcacagctcaccatggccttgacttcctgggctcaagcaatcctctcacttcagtctccctaatagttgggactacaggctcgtatcaccacgtgcaactaatttgttttgattttgggtagaaacaggtgtcactatggtgcccaggctagtaactcctgtgctccagcaatcctcctgccttggcctcccaaactcctgggattacaggcctgagtcaccaagctcagcctctcctcatcaaaaccattccctctttgtaagattcttcctatgtcttaaaacttaatacctttaatccttccctggagccatagttttatttatttatttatttatttatgagacagggtctcactttgttgcccgggctggagtgcagtgacacgatcatagctcactgctgccatgacctcctggactgaagtgatcctcctacctcagcctcctgagtagctgggaccacaggtgtgcgccaccacaccagttgttgttgttgttgtttgtttttgttttggtagaaacagggtctctccatgttgcccaggctggtcgcgaactcctgggctcaagcaatccacctgcctcagcctcccaaagtgctgggcttgtaggcgtgagccaccgcacctgtccctgtctgcttttattttatttttttttgagatggagtcttgctctgttgcccaggctggagtgcagtggtgcgatctcagctgactgcaacctctgcctcccaggttcaagccgattctcctgcctcagcctcctgagtagctgggattacaggcacgtaccaccacacccggctgatttttgtatttttagtagagacgtggtttcaccatgttggccaggctgatctcgaactccagacctcaggtgatccacccaccttggcctcccaaagtgctgggattacaggcatataggtaagccacagagataagagtagcaagcagtgatggggagaagataatctagtgtaggaaagatggaaagaatggtgatatttcacaactgctagattgacactttaacttgagagttatccctctataaactggatatttgctgagcaaagtttaaagaaaactccatgtattcagtaatgttttccagaccccacttctcttatataagccagtggcttagagtgcttgctctaatttctatattccattaaacaagggtgggatttcttctcattcaaaccatttgtgactttgccctttagtgacctctaccatcaccctatcattaatgatccaagtgattagaatggatggctatgtgtttgtaggttgtttgttgtctttaatgaatagattcattgaatggaattaactgtgctcttctagaacattggatctgtgttctcatttagattgtatttgtaatctccccacttcccaccatcaacagtggcataatgtgaattaatttatgtggtatctgtcatttaaaaaacatgagctctctccttcctttttttgtcttaaacataggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggtacagagtactcagttcttgggaaagttatggcaggtttaaggaaacactgagcaaggaattaaaatatctggatttgagttccagctttgcctttcttttacttaaccttgtcaaatctactttccaacctcagcctcctgatgagttcagtacctaacctgagttcagtacccaacctattgatcttaacagtgttattgtgaggattgggaagacttaagttacaccaaagagttttgtaaagtatagaaacatcctgtaaggatcaagtagcagcaacagaagtagtagcaggagaaccaagtagcagggattactggcgttactgtgtgtggcaagcactgttttaagaacatatactgactgatttaattaacacaactatattaattagttaccattatccctgttttatctacgatgagcaactgaagctcacaaaggttaaataatttgcccagatcactcagaaaattggaggagctaagatctgaacccatgtggtctagttcaaattgtgcatcaaagtgatctctgaaataagataaatatttacttaacttgattataaatattttatgaacatcaattattgaatatttagcttggcaatggaatatttaaccatttttgttttcctttgtgtcattcccttttatcaggttgcccacattcccaaatcagatgctttgtactttgatgactgcatgcagcttttggcgcagacattcccgtttgtagatgacaatgaggtgaggtataaaataacctggttaatagaaaaactccatcataactataaaataacaatctattctatgtaagtcccgtcaatgaatctccatttaaaagaataaaaacatttttaggaggaaattttttaaccaaggaaatactcttgtcaaggaaaccttagcctataaataactttacaattaagaaaaaaaaaaacccttcacacaatacaaaaccaaaaccattgactattgcatagccagaaacatggacagcataaccatggaaacaaataacccatttgctgcaagtatctaagaggtttggtgagtaaagagccagctgggcaataaacgaagacttgttcagttaacaattttaataaatctgttttatctagtaccactgtgctagatattatataaactaaatcctaaagattgtacttacgcattttaaagtttactttcaaatgcttaagctgaaacagaccagcaaattataaatttgagtcagtggggtaggaaaaaaagatttgttatttacaaacggggtcatgactggttagtaagtagagagacacagaactgcagctgattccattttgttttgtagtggtgccttagagcttactcatcccctgttggtggaagactcataaatcaatgccttatcaattttaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacaggtaactaaaatagaatgtaatactggagattttttttatattcagtgcctttagtcattctgattatttatataccacctatttataggaaggattggagggtgctattaactta

SEQ ID NO: 193513 - DNA, 5808 bp, Homo sapiens
aacagactggcggcgcgcggaaaacgcgtcacgtgacgactggccccgcctcttcctctcggtcccatattgaactcgagttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacacatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgttttggtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagttgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttagtcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttatataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatgtgtgtgttgttttgtcacttcacaatgttcatgtgacttaaacactataggtgaatattttgacttattttaccagtaagtaataaaacaacaggaaacttg

SEQ ID NO: 193514 - DNA, 34 bp, Artificial Sequence
  Antisense oligonucleotide
uaggaaagacauuccucauuccucauuuaggcaa

SEQ ID NO: 193515 - DNA, 27 bp, Artificial Sequence
  Antisense oligonucleotide
uucugcuaccauauccaccacuuccac

SEQ ID NO: 193516 - DNA, 19 bp, Artificial Sequence
  Antisense oligonucleotide
taggaaagacattcctcat

SEQ ID NO: 193517 - DNA, 25 bp, Artificial Sequence
  synthetic polynucleotide
atccuuucuguaaggaguaaauccg

SEQ ID NO: 193518 - DNA, 25 bp, Artificial Sequence
  synthetic polynucleotide
aagacgaugguauagguggugaagg

SEQ ID NO: 193519 - DNA, 410 bp, Homo sapiens
  ref <308>: DATABASE ACCESSION NUMBER: NM_199234.1
  ref <309>: DATABASE ENTRY DATE: 2010-03-10
  ref <313>: RELEVANT RESIDUES: (1)..(410)
atgaagttatgggatgtcgtggctgtctgcctggtgctgctccacaccgcgtccgccttcccgctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 193520 - DNA, 19146 bp, Homo sapiens
atgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactgtaagaaccgttccctccccgcgggggggccgccggcggaccccctcgcacccccacccgcagccagccccgcacgtaccccaagccagcctgatggctgtgtggcctaccgacccgtgggcaaggggtgcgggtgctgaagcccccaggggtgcctggctgcccactgctgcccgcacgcctggcctgaaagtgacacgcgctggtttgcccagcacagaggggatggaatttttatgctgctcctttagcattctgatgaacaaatatcctccccaccagcaccaccacctcagaaacacacacacagctgtccccttttctgtttcctcacctatacacactcccagtttttctttgcttccaaagccctttatctgtgtgtctgtgcctggctgtgcttaattctgagaactattgcactttcatcctaaactgcgcctgcaaggcgagaggccggcttttcacaaaagcaagccagaggcagagaaaacacagaagggcctccatttccagaacaagcgtctgggtaatgtcaaatctgttcagaaaagttcctctgttcagaaaagttccggttctagaaagacttaaccataaatagtgctggctgggactagggacaaagactgtagctcactccacgtgagacaatgctaactcttgagaaaaaaacccaggttattcttattagaaaataagtctgtgatttacctctcaaaaattaacatgttttagaagcaagtcaattagggcatatcagctgtgatgtgatctcgttttccctccactcctcagaagcttgttgcatgaagtgagagaggctacattacatgtgatagaggctgttgcagaggcataatgtcaacaaagatagcaatagaaaatttcacacaaccccaaaataaagcaggaatgagctgtgtgtaactaggataccaccctggctactcttccctccctaacgccacccccagaattatccctctagtaactttgcgcttgaaacttactatggtcataaccacagtagtagtcctgcagtagtcagctgtgcgctgagtcccccaaacccaatggccttggctaggaaacaacccagtaaatgcaatgtgcttattttatgcttaattatagcaacaaaagcaccttcttccacaagtcccaagaaagatagaaagtggatttttttataaggcaaattaagacttcaaaaggaagttagggaacatggttaatcctttgaaactaaagtacctgttccaagagtgtctgtcaattaactgtataaacctactttaaaggcttttatttccatcacaaatttaatgtatataaacgtttctccaacagaaactttaaaatgccccttagtgccgggtcttccaaaactggctattcattcactcaaacggtctagacaagagggacaggaacacagtggcagataatagttctctaacccagacgttgccaagagaaaaatgactgtgcctgattacaaagctgattaattcatggaggtttaattgctgtattagtgccctgttcaactagattcatttaattctggctcaggctcctggctctgctttcaactaactctgtgactttcaggcaagttactttagagctcaatgaactgtaccataaagagaagcctttctactccacaatcccagtggctatgagatttgccccttggcctttatgtttgtcctaaagtcctttgggaagaatctcctaagaagagattggagtcacctggggaactttaaagactactgatgctaggtctcaccccaggagattctgatttagttggtttggggtgtggcccaggcatctgagtttttaggtgttccccagatgagtctaatgtgcaaccagacttgaatcaccatggcttgataacacccaagaaaatctttggctcatataaggtacaagtagtcacaaagcaagcgagttaacacagattgcagggacaagggcatgttgtagggaagagggattgcttcccttttccaaaattgatgctgtgtcatcagtgaacaagattctcactactctatttacatttgaacagcaaaacacaccccattgtgttttgtctgtgggaagacccaatagatcccagaggaaacctgaaaaagaaacgttcccaaagagaaactgagctgcattctaagccaaattgacttctttccagatatgtttgattcggtagcaagctgtcaagtgcagggaaggcaaaataatgacagtatgcagactttgaacactcaaccagtgtcaacacgcctctgtcacagtgctgacatttatatcctgcactgtacatggtgcaactggttaaggcttatgtagaaaaacattaagtcaccacatttcatttaaaaatagaaagtatcataaattctgattcctctagttccatccaaatacttgtaacttaatgattgagcaaaagagctttcatgccacattaacgtcattctgcgcttttcacaggaggaccagaatatacacagtttgcacactcacctttaagattgcatgtgttccgctggttccaatgtaaataaaacatccagaattctattactagtatgccctcagtgtgagataaccaaatggaattcataattggccaacgggcttgcctagaggctggctgtaaagtaaatggctcaggactgcctcctgtagcaacttctagcctgtctaaactcaaggacttgtgatttgacttttggggtacccaagacttttctcttttgctatctttatttgtttattttgctttttgccagtattttgccagtattttgctttttgccagtttccaaagggcaattagagcaggcatgaggaatctgcaagttgaaacttgcaaatgtcatagcattttcgagctgaaaggaaacccctctagtcctgaaacctaaagaggcaaagcaacttgtctataatgcaccacagttccatgatcacaggaggcaggtctgaagctgggaccagagtttcccccaaactactgaaatgtactttatatgggaaggggaggatactttatatgggaggaaggtcttgaactaatgatttagaccatggtgcacaaggttgtctgaatttattgaaggttagttcatcatagtcatattccttatctcaactctaaatgtatttaataagtaaaagcataaaatgcatgtggttttaaaaatttgcatctaaatgcacatatacattcaccaaatagttacatgtatgcctgtctgtgccaggcactgtcctaagtgctagggataccttgatacacctaataaacaaaagtcgctgccctcatggaacatagcttctagtaaatgcacatgtgtggtggtatgaaaaaatcaacgtgaaagaacctcagtccagtaaggtgggctgaattttttgtgcaactggaaaccaactaaaatgacattgagcatcgttaagttgtaattacaagtaattcctaatttagtataatataatgggattatattctaccagtttggtagcagttcacaaaatttcctatggaaacaattttttaaattaagctatcaagttttcaggctagcccacaaaaacctatgtaaaccacgatataactgaactgtcattcacaatattactaagtgagagtctctgccctggggggcacatcccataatctgcaaaaggagggcacagaacaagaaatcagggaggtttcagcaagcaagagctcaaggtaacacattcagaccagactaggatttggaccccagccttgccacttaactgagatgttgagctgttacttaacatcccttaagctttgttttttcttccctgtaaaataggcataagagtaaatctgtctcatgggttgatgtgagggttaacttagatattgctttgtaaagcctctgctccataaatagggatcatagttgtcatttgccaccctcctgcttgcaatggcccctccctgggcacccagtgaattcacttcttccgctacgacatctgccaggatgctgctctaaatagtgggatttcagcagcacaacagagtacagcgagtgagagaaatgcaggccttgtgggcaggctattttgggccccactgttggttggtcagcacgtaggcagtccaggcttgcctgggattctgcccctgggtcagctgcccctggctcttcccaggtttcacagctccgacccttccccagtttccaagcccatatatttccagtggaatttttttctcaccaaactcctatggttatgttagggagacctcttccgtcatgggaaggagggaaccaaggcagggtaggatctttctatggaagtgacaagagggttgtgagttggaggctacctgtatggagatggagcgtatctttgtaaatgatccatcccagctggacatttaatttaagaagtttcataaccctagcaaaaaatacttagtaaactgtgagaccacctctatagagctaaggaagcttctagtgcaacaagctgggtaaatgttaagctttcaaatctaatgttatgaaatacagaatttagaatgaacaaacaccatctatctgttgtgtcttatcgcttagggactgtatgaatgaacaatactttaacaaagtaactacctaagctggaaaggagctctgccacttgggatgggtctcttggaatcaagaaactgcacatcagactcttgtaggaggcactgattctttacttgagatctgagaccaatattctcattctggccccagtctggaaaaccatttcaaactgttactgcttagagaaatctatttaaggcttaaattgatttggccagtcaggaccttaggctgacccagggcgtgagcaatgtactcaacaggttcttcttcaacagatataaaaattaaagctccctgatattttcccctcctaatatctctttgatctttgtttatttaacactcatggaccatagcaccttcatttgattaaaatacttgttttttagttaattacttaagcttaatcaggaaacaaatattaaatatctttcatgtactgggtgccatgcggcctcaaaaaggctaaatttgtaaataaagttgcttgtgatctagctgtaaactattgctaggtggatgggcggatggctggatggatgaatagaatgtcagtcagatagatatgtctattgtgtagggtttaggtgagctgtacgcatgtgtggtaaaaattcctagcagtgagctcactgggatttgggtatcatagcagggacgacttcagggaagagggaggatttgacctggtacttgaaagatgggtgtttggaagggaagggaaaaggaaagggggacatactagggagtagcatgggaaaatttgtgaccatgatgtggggaagggacagtggaacaaagaggaggacagaccagtctccaagttctagaaagaggtgctaagaagtggtgggaaattgaagatgtcttgacaggtgataccagattgtgtgatactataaaattcaggaaaggtgtttgctctgtttttgatagcagtggggcacccatggagcaggcaggtgactacaaggcgggatcttgcttcaaagctgtcttgcaggagaagttacctaaatacccagactgcttttgagtggggcctatgccgtaagcatgtcttttattttgaggtgttgtgcttttatttttaaaaatcttctagacataggcacaattgaaccaaactattagccccaagtaagtgaatatctgcaaataaacacttaatattaaagttaatgacctagcaccttttaactatccacatgatgaacacagttcttgtcctgaaatcaagtaagtctgagctctacaatagaagaggagatattattatccccattttacaggtgaagaaaggagacctagagagttgttccgggtcacaaacctagtaagtggtgaagccagaatttaaacctcagcatgttggtccgaaagccaatatttcttgactttacacagactgtgtgtgcatattagtgaattaagaaaatatagactttggcttgcttaaaaatgcactcactaaccctgaaacacagatttccaggaaaattaagcaagcaaagagaaaagagaagcagagactatcaaatttccttttggcccttttaaaatctccatttgggctgcggtaggcttaagccagtattactaatgactacttcaaagtccagatcaggatgtttttaagaagagaaacatgaatttctctaagtattcctataatattgatgctttttgcaatgagagaaggctccctaactctttgcaacaaagcaaggtctcctcaagtgcttggtaggcagacagcattcgggaggccttgtgggagactctggttctcagatctctcccattctgcccagcgaggggatggcatccacataggaacctagtgtgactgcacgagtgccagagcgatggcctcagtgggaataggagtatgcgtaagcagacttgggtcaccactgggaaacaactggttagctcagtagaggcaaaacccacttttgcataactttaataacaaaattgaagtagagaagcatggttttaaaacaatatggccttccaatttttttgcctgcaaacctgcaaataagaatgttgaaaaacgattacctactttgaagctttctaaaatttttcatcataggtttaaatagttacaccagatgtcatttctagccctttcaggaactgtatatatgctttaaatattcttttggcaaaactttgcacctgcctatgtagtttatttagttcatggaaaatgatcaaactaatcagcccaaatcaattggctttttggtcagaaaaggtctgacttcattttcaattcaaatgtacatgttaatatacaccccatgacaactgtcacaattctggatcctaattgtaaggtagagagatggataggtgaacagtcagataagcaaagaaagcactgaggcttcccaaggggcctggccaggaggaaatatggagcaactggcttcaggatttcttggtttattcacaaagttatctccctttgcaagtgtttgtagcacagtgaacacccatacatccttcactaagattaacctcttttttagcattttgcctcgtttttttctgaaccatttgagaatttgttgcaaacatcagaatgttaaatatttcagtatgtaccttctaagaacaaggacaatgtcttatatagccacaattcagttatcagtctcaggaaatttaacatggatataatactgttatccaatagatagtctgtgttcatatgtccccagttgtagcaattatgtcctttatgttttgtttttttttttttaaaacccaggaccataaattgcatttgactgtctggtatctttatacttccttaatctaaaatgattcccaagtctttttttcccgcatgacattgacatttgtgaaaactctgggctcttttgctagctgtttcccagactacccttcagtttagatctgtctgattatttccacatgattagatgtagggaaacatccttggaatatcatattcatggcactatgtcctcacatcaggaagcgcccaatatcagtttgttccaaggagccattcatgcatgaatgcctttgtatggcgcctgaaggtgtttatccctgggacaggccccacaatagaatggctagataggtgagaagcacaccgtctctcagtaaggataaagagggattggaaaaggggacatgggcaaggagaaccacagcaggagcatccgcaggcagaccagacattttaggacatggcacatgtggaaattgaggaaatggacatggattccctttcaaccacccataggcactgcagaaagtcttcctgtgcccccagagggccaggtgcctcagtctgaagacactgctctaagccatagtggacacaaagataaccctcatgggctctggggtctgctgacatttgcatgtttagttgtcaggcattttgaggaacacggaagagctcacacagcctcccaagacgggcctgtggcttctgcccacaacccaccatgccaggggctccaggccctgcacagaggtctctcctctgtagaacatgctagactaagtagggaccagtgtctggatccccttttgggcaatcttgctttgtctagagactgtagagttggctttacactgctgccttctgtgcaaatattgctgaaggaggatcccagatgtgataaccatattggcctacattaggcaccatttgtgaaatactttctgtggaccaggaactgagctgaaatcttttcttatgttatcatattaattttgacctgaaggtaaaggtgtgactagccccatttgaaagatggggaaattgaggcttacagggttagcagcttagccagggtctggacacagggcagcctgagtccagcactcacacttgtcactactgcacaagatcacttcctgccagcccatgacactcagatgtcactcttctgactgcatcaaaaagtcatcaaggaaaaaaaatcagggaatgggtttggcaggtaaagttgttttagaatgataaccgtatctcattacctgaagagtctttgagattcccgtaaattcactcactgggggtagaaattccctcctcatatctgaccacaagaatctaccaaacaaattcaaatgataaagaagatttctttcatcttctcttagtccctccttcttgttcaaatcactgagacccttacatgccttttacctactgctcagtgggtcccctgggaagagctgagggatgctgagtgcagaatcctgcagggtcctgcagcctctcaggctgggggcagggcttcgctgaaagaagaaaggagagactccaccacccccacaaccacctgcctctgataacaccacagggatgatttgccctagtggctttttgtgcacttaattttactgggtaactttctcacccttccctgttaagttttttataagggcagtagcagacctcctggtgtgtgctcattagcttgtggtgtttattaccgactctggagtgcttttagctcacaccaggtgttcatggattagctaacaaatgaacaccctgttgggtgttttcctgacttaaaagctgaagaatggacactttccacccagggggactgtgctgtattactgtaaaattattagcataactgtaataaaagcatggaccacatacatagaaatcagagcaaggtgatcagaacctgagtaacaaaggaatttactgtctgtctctccctgagtggggttttctggctgtttgtattgatggagtaattttcagtccatttattacaaatttgcttagttgagttgtaggataacagtttaggatatagtacaactagtatgtgcaatgtcattcagagtgggtggagatggtaaataagatggcattttgatgggcaaagtggcttttctaagtacacccatagcttctttttctatattctaaagtgatttgcattctggttggtctttttcttctgccttgagagaatccagaaatgcttttttaaaacaacaaaacagtggtgtttttacaacgcaaatacttttcaaataaatcgatgtcatgccttactgtcaacaaaccactggtcctgaagagaatgcactggtagctctggaaatggtcacaatgacttagtaaattgcctcagctggtaattgtttttaggaaaatagatgctgtggacacttctgaaagttaacccaacagcagcctatgatcaggacggtctaccaaacactagatgaattctgtgtccaaaataggaaagcacggaaggtcattacataatgtaagatgcatcagcattcagtgcttactgatctatgggccttttttaaaaagtagttcaaataagtgtcaaagtcatcactttgaaataggagcagataacaaaactttacagaagtttttcagagaactagaacattctcataaactcacatttagagtccattctcatggactgcacattttagaggttcctgaaggtcaaataagaacaagagttgacagcccagagattggcttcaaggacaagctgcttggctctcctgatccattttgtaccacttgcagtgggcaattctagccttggagtcataagctgggtatgacctaagcatacttgaagcagcaaaaacagaaatgaataaaattgagattcgaagaaaatggtaaattgagtgtttgacttttgggtgatggagactgaaggaattgtagcgtgaggctgtagtgtgtcctctcaggggtcatggggcccatctctatttttacagatggaaactgaagtttaagaatgccttacagtagaatctggatgctttcatatgcagatacagggccctttctacacatcttttacctctcttaaatagggcacaggaagatgacttgatgatttaagagaagattgatgacggtcatttcaaatgtagccgagacattcagccaagaggtaaactgaagaggtcaagcactgcagagttctaaaatacctcctgtggggttttatggggcccctgatggtactggctgagctgaatgctgctggggcgtcagccagaggtggtctactcccttgcagaggtgactgaaaaacccgtgtctggccacactttccagccaagacttagactctccacactttagcattttggagctggaaaaggccccagagagcactgagttgacctcagaagggttaagtgactacttccaaggtcacgcagctgatcagggactgacccaagactggaatccgggcctctcttgtctccaactctgcagcaagagcctggtcatttggtgccagcatgagttggaggagcttccggagatggggcctctctgtctggatctgctgctgtgctggctgcggcttttccggttttaactgggaaatcgccagagctgtcttagcgtgatatgcaagaaccaggacacaggagaaatgcccctgagtagcatggcttttcctttttgggagacaatttactgtattctgtggcccatggcagcctaactttaggatctacttagcgtacctgagttcgtactgaatttttcaacagaaagtatgtttctcacctcctgtgctgactttggtaaatgtgtacaggtgaaaccagcatgtcttgctctcgtctcagagtaaattcccatctgctgcaagacttgaagagctcagtggtagtagagtttttactttaaaacaaaaagacaacaagtttgagctttgaaactgaaccaccaggtccacatttattagtcctatggacttcaccaaatatttgtcttctctgagcctcagcttcctgagctgtaaaatggagatagtattcaatttagccttgaagggaggttgtcaggtttaaagttaatgttgtgtgaaagtaggcagtattccacctttacactggtaatgttttttaagtgcttcaaggaagctcttatctaagttatagcctgatgaaattttgtaatgcaagaagttttacaggttaaactcagccatgtagttcttgtaatgatattccaatattagtgaaagaaaatcatgtttgtaacatatagaaagataaaaataacttattccaaaacaatgacattcattgggactcttcttgagaagttgtatcaattttaagttgatcttttcttttcatataagtatgtatatgtgtgtctctgtgtgtagacgcatatgtatgcacgcatgtgtatgtgtatgtgtttatagatcgagagagatctctatatttttcagatacttggcctgtagagcaatttgcattttacctgcaatataggtaggcaaagaataccagattaaatgtctcccaccattagggggttttccattttcctcctgtctgaagacagcctttcataggaaccgctacatgtcaggatggatggcaccgcacctcggcagccgcaggtgcagcatcctgtggcctcatcctcagcatcctgccccatcccaaaactgagccccaccatctggccactggttcctgatgtatctctcacttgtgtggccttggctcaggcagcagctcacccctatgggtcccattagccctcacccttccaggcacagaagctggacactatagtgaagtagcaaggctgttctccccacagcaagaaacccctgagccttctctctggggcccctgcatcagccaagcccggctcatgcagatctcaagcctggcctggaagacatctcctgaacaggaccactgtgtgtactgaggtcaggccccctctctcctgggtccctctgagcctcaaagaccttccttccaccttctggataaggagttgtgtcctcaccactttgtccctcatagacaactttgtgccatctccctctcaggcccacaggttggggacttaggatgacttagaatgaaagtcagcttagactccctgcctggccaggctgaggaggggacaaccagctacaagtagaaaaatgaccctttgattaaaatatagttaacctgtactgttttaagacaaatctggcattttacgaaaagactttgtccactcttgccagcttaaccaatgtaatgttttggattatgtaattttgagttcagctattacagggaggacttggagccctcaccattgttcctattaaaactcagttgactttacaaaatagtcactatctcagtcctttgttcctgggatgacattactattttttttccccataatcgagggcagcaaagtctttgcggtgaactgtttgttcccagagttgtgccccggtacaaggtttcatttctttaagtaacactatttatacaaagaacacatcaaagttaaaatattttaaatagaataacaccaaaacatttggttgcactctgaaggatagcttaaatgcatttgagcactttggatttccaaaaactttatattttagatggacatgttttccaagatatatcctccaagcaggtctgggaaatgagcaaagatatgacctattatttttttaatgatgctcctcttttgtggtttgcaagtatttcactattaaagttaataaatgagggtcatttgcatatctgacattctgccaagccttttaaaggatgaagacagagatgcgccagtaagtcttaatttagggaacgaatccaaacccagacccctcttcttttccctcagctcagtgaattcctggaaaatggaggcagctgtgggcatttcagctcatcaccaggagtttcttgtctgggctgggtgagaggcctctgcagaagaattaaggacaggctcagtgaggctgcccagcatcctctgcagaggagtatggcgcctaatgcccccaggtgcctcgcatcgataaattgaggctggctctaagaatgaactcatttagtcggaacatgcaggcctatttgccctgtggtttgaaaaatacaatgttgccctttcctggcttccagaattcatatccatgtaaatttttcagcaaaaattttgttgtttcttctatttttcatgactatgaaggaaaaaaaagccttcagcttaataagagttgcctatggcctgaacttggggtttaaataatatttccacattagcaacaaaatgtgaaggagatttcccatcaaaggaaggaattttcaaaagccacatgccaggaagactttaaaaaataataataataatagactttattttttagagcagttttaggttcacagcaaaattgaaaggaaggcagagagttcccatatactccctacccctacacatgcatagcctcctccattgtcaacatcccccaccagaatgctacatttattatagttgatgaacctacattgacacatcattatcactcaaagtccacagttgacattggggttcactcttggtgctatacatcccatgggtttggacaaatttgctatgacgtgtattcactatttacctgaaattcaaatacaaccaggctttctgtattttacctggcaaacaaagcctgtgacaaagccatgtggtcaaaatgtcttaaaaaggggagaaaaatgtttttcaagttcttccaagtatcaagggctaaaaaagaacactataagtgctgattcaaatccttatgattgtaactctagtaataaaaagttatatatcatatagattaatgagtctctaaaccagcatgatttaaacttctgtgactctaatgttttcctattagcttatattaaaattttagtaatgttttaccctcatttctgattaatcttcagttgattgttaattgaacttaactttctatatgcccaggttcctaaattaatgacttatttagaattcttgaatagagcctatgatgtgagtccttttgtaaaacagagtctctgttttttaatttgaagactcttctgtattttgattaatcactcctaatagatctgtttcataagttccgatttatatacaagcatgtttttttttgaaactgggcacatctgtatttatttcctctttaatagcttattattgaaagaaatcaccaatagctaaagcagctcatttttttttaagtcaattgtttctgtcaaccaaagtgatttaatgttgttgttttgttttgttttgaaagaaaacttcctaaagaaagttcagtgagaaagcagtacaaaggaaaggacaaattaagagcactcttggccaggcacagtggctcactcctgtaatcccagcattttgggaggctgaggcggacggatcacctgagatcaggagttcaagaccagcctggccaacatggtgaaatcccatctctactaaaaatacaaaaattagccgggtgtgatggcgggcacctgtaattgcagctacttgggaggctgaggcaggagaatcacttgaacccgggaattggaggttgcagtgagccgagaccatgccattgcactccagcctgggcgacaagagtgaaactccgtctcaaaaacaaaaaaaaaaaaaaaaaaagaaaagagcacttccctgggcccccttaagaaagcattactcagggaccagagagctttaggagacccaggggaggtgggcactgagagttaatgctgctgcaaagctgcagaaagctgaggaggaaaggtggtttggagacagtccttcagctctctggtgggcaatgactgtgccactcagggcagagtggcttttctgagtaatgtgggctgtttactttggagcatttcatttcataacgatgcagttttcagctaaagtcccagagtccccttgaaaaattaagaactctctttccgcctagtaaaatgacccgactcattcagccagcagttaccgtaggcctccacagcctactcaagcacttggagatccatcagtgaacaagcaggacagagttcctgcctcttggagttgacattcttttagagaagacagactataaataacaaccctaagaaatcagttagatggtgtgttagaatgtagcaagaattatggtggagggggaggcgcagggcaggggtatctggattaggggctggggaggaatcttgttttaaatagggaggtcaggtgggacttgtggatagtgacatttgagcaaagacttgaaggagatgtgggactagccacagggtgggagacatttaatctggtattctttgcctacctatattgcaggtaaaatgcaaattgctctataggccaagggtccaggcagagaggggacagccagcacaaaggccctgagttcttgactgtttaagctatagttctcaagggatggtgttgcccctaggggacatttgcaatatccagagataccttgatctgtcatgactaggatgggggatgctatgggccttgtattagtctgttttcttactgctatgaagaaatacctgagactgggtaatttataaaggaaagaggtttcatggactcacagttccacatggctggagaggcctcacaatcatggcagaaggcaaaggaggagcaaagtcacatcttacatggcggcaggcaagagggcataggcaggcaggggaactgcactttataaaacaatcaggtctcatgagacttattcattattaccagaatagcacaggaaaaacctgcccctgcgattcaattacctctcactgggccccctcccacaacatgtggggattatggcagctaaaattcaagatgatatttgggtggggacacagccataccatatcaggcctctcctggatggaagccagggatgctgccaaacatcctacagtgcacaggacagcctcccacaatgaagaatgacccagccgaaaaggtcagtggtgctgacactgagccccgtgtttgaggaatggtaaggaagccagggtagctagacgggagggaacaagaagagaaacaagagaggaggtcagaggtaataaaggctggaggagaggggcagccaggtcaggtagggcctttagggccagtgtggatttgggctttttctctaagagtaacagagagctattggaaggttttgagcagaggaggttatgttctgcgtttaaagtatccctctgggtgctgggtagaaaatagatcgaaggtgggtaagggtagaatgaggaagcccagttcaggggccactgtggttatccaggcaagaggtgacagggcttcagccagtgtggaaacagctttgtgatttccgtgcagctgatcctgccaatgctaaatttcagatagcaactaggcattctacggattccaatcaccagtcttttcattattatatatcatatgttttatatattacacacacacacacacacacacacactctacacacacgtggttaagttgcttttgctagattttgttctataggagggatacctgatatattttaacaattaaataggttaggtttatgacaaaacaatttgacatgggttagacataatgtaatctttctatgctttaatacaatcttggcaaaaaacatttactcttgctgacaactcttctttggtttatttctctaagccacttagaatcctaaacatactaaatgacctgaaaaatgaggtgaggggggcataagaggcctactacccaagaaacaggtgtttggattgtttttccccccgtttagaaatttattacattgttccattagttatttttctctgctgacttgattggccaaagcaaacactgaaatccggcagaaagcactaagagactgctgatttatactttcaccaaaggtctcagacatcttagtgtccctgcatccttcctccatgtgatctccctaatgagcctcttgtcctgcttgcagccagacagtgggagccatgtgacagcttgcagctgaggctggacctcacccttgggggcagggctgcttctatgcacgaacagcatctcatttcatttattgctgtgatacataaatgccattttactctatcactggacttttttgttaaagtcatgctgttcaaaggaagcggtaaattagtctttttgttagtaaaatataaactgttttcctgttcctttatgatttttaaggaaattttaaactatagttgcattcctgagctcttcatttgttctgtcagaatggttcttgtcccactcagccacacagaatcaaagcaagtttcagggaagagcactcagtattccagatgaaggtagccatagtggaaggcctcagttttttcaccctctaagacggtgtctctcaaagtttagtgcgtggatctttggtgtgtggatcttttacattagaattccttgaggcttgttagaaatgcagattccttggtccctccccagaccaaatgactcattgtctccaagggtagggccaagaatctgcatggtagtcaatatccagggtattttcctgcatattcacatttgagaaccactactctaggttgtgtgactaggcaagaaaaatgcccctagaagattggccagctcacagcaagctctgcatggacttgttaaaaatggtgaatgttattcaaatgaaaactatgcttctaaggatttgttttcttcgagaaagtatgtcaccaccacattagtctcctcttccaactaaatcatctttcttctgtgcatttttgcctctgtttttggggattacagtggtcctatagcttaatcggctgatagttttgctgtgggtccaatttttgctgactttaggggggcactttgatcttgaagacggcttgaaatgatcattttgtctcatgtgccattttctcttttctttttgaacagcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 193521 - DNA, 237 bp, Homo sapiens
tcgataagccacgccattgggtttgggggactcagcgcacagctgactactgcaggactactactgtggttatgaccatagtaagtttcaagcgcaaagttactagagggataattctgggggtggcgttagggagggaagagtagccagggtggtatcctagttacacacagctcattcctgctttattttggggttgtgtgaaattttctattgctatcttttggccttatcgag

SEQ ID NO: 193522 - DNA, 1246 bp, Homo sapiens
  misc_feature (703)..(703): n is a, c, g, or t
  misc_feature (709)..(709): n is a, c, g, or t
  misc_feature (943)..(943): n is a, c, g, or t
  misc_feature (1152)..(1152): n is a, c, g, or t
ctcccgccgccgccgccgccaacagggcgagggctgccggcaactctcccgccgggcccccgcacccccagaagccgaggtccgagcagccgccgctgctttgggtggggggctgacagggctgcgcgcgtcgcgctcttggctggggctgcgcgggcccggggcgctgcgggcggctcagcggcagctgccgcgctctgcgcctcctctgggcgcactgcctgggagcacgagactggtttgtctgatgctgctgccggagctgaggtcttgcctggagatccgaacgagacaccacgtcaaccggcgcggggagtcccgtgaagacatgagggcgccaggagcgcaggctggtcttctagagcccgggctgggggtccggggtccggcgtgggggaggggcagcgcggggccccgacacgtatgggaaggcaaggcgacactcttttccgctcgatgcatatccatcgtacactcccacatctctcccctaagcctccccctgctccgcaccttccaccccttgtcctggcacccccaccacttctatcctaaccttgcccagctccctcccactcatccaggtagccggctgtcgtgtttcgccaccactcccctcccttcctgccggtaatcggtcgggacccccgggggggcacggggcgcccccaaaaaaaacaacaaccagaaaaaaagggggatntttcgntcccccgttccgcctccttgctgcttactgtccactacaatgccttggccttctccaatccaattcctcccatcccatccccgcaaccagttctttctcccccgcttcatttccttgttttatcgcatatgtcgtccctcctactatcgtctacccccccattgcacctcatggtcctccccgcccccgatgtacttaattgacaatttgccccgcacataccttttaccctcnacacacaccttacgcgcagtgacccacgtttactacactacccactttattccccaccggtttggacgttcccattccgtgggcttccttgcactttaccacatatccaccccacgcatatgctatatcccagtaacctgccaattactcccgcctggtaaatcatacccccccttattccccgtcacactatcatatcccacttccanacccacctataaaccacatcaagaactatctcacatatctagaaatcttttccaatatttgccctgcctcaaatcgatgtacatcctttgacat

SEQ ID NO: 193523 - DNA, 684 bp, Homo sapiens
  misc_feature (366)..(367): n is a, c, g, or t
  misc_feature (628)..(628): n is a, c, g, or t
  misc_feature (647)..(647): n is a, c, g, or t
  misc_feature (652)..(652): n is a, c, g, or t
  misc_feature (662)..(662): n is a, c, g, or t
atttgggctttttctctaagagtaacagagagctattggaaggttttgagcagaggaggttatgttctgcgtttaaagtatccctctgggtgctgggtagaaaatagatcgaaggtgggtaagggtagaatgaggaagcccagttcaggggccactgtggttatccaggcaagaggtgacagggcttcagccagtgtggaaacagctttgtgatttccgtgcagctgatcctgccaatgctaaatttcagatagcaactaggcattctacggattccaatcaccagtcttttcattattatatatcatatgttttatatattacacacacacacacacacacacacactctacacacacgtggttnngttgcttttgctagattttgttctataggagggatacctgatatattttaacaattaaataggttaggtttatgacaaaacaatttgacatgggttagacataatgtaatctttctatgctttaatacaatcttggcaaaaaacatttactcttgctgacaactcttctttggtttatttctctaagccacttagaatcctaaacatactaaatgacctgaaaaatgaggtgaggggggcataagaggcctactacccagnaaacaggtgtttggattgnttttnccccccgttnagaaatttattacattgttcca

SEQ ID NO: 193524 - DNA, 400 bp, Homo sapiens
  misc_feature (19)..(19): n is a, c, g, or t
  misc_feature (21)..(21): n is a, c, g, or t
  misc_feature (34)..(34): n is a, c, g, or t
  misc_feature (39)..(39): n is a, c, g, or t
gaacaggtttttttgaaananaggattaaccttnttccntaacttcctttagaagtcttaatttgccttataaaaaaatccactttctatctttcttgggacttgtggaagagggtgcttttgttgctataattaagcataaaataagcacattgcatttactgggttgtttccttcgataagccaaggccattgggtttgggggactcagcgcacagctgactactgcaggactactactgtggttatgaccatagtaagtttcaagcgcaaagttactagagggataattctgggggtggcgttagggagggaagagtagccagggtggtatcctagttacacacagctcattcctgctttattttggggttgtgtgaaattttctattgctatcttt

SEQ ID NO: 193525 - DNA, 619 bp, Homo sapiens
tttttttggcaacgtctgggttagagaactattatctgccactgtgttcctgtccctcttgtctagaccgtttgagtgaatgaatagccagttttggaagacccggcactaaggggcattttaaagtttctgttggagaaacgtttatatacattaaatttgtgatggaaataaaagcctttaaagtaggtttatacagttaattgacagacactcttggaacaggtactttagtttcaaaggattaaccatgttccctaacttccttttgaagtcttaatttgccttataaaaaaatccactttctatctttcttgggacttgtggaagaaggtgcttttgttgctataattaagcataaaataagcacattgcatttactgggttgtttccttcgataagccaaggccattgggtttgggggactcagcgcacagctgactactgcaggactactactgtggttatgaccatagtaagtttcaagcgcaaagttactagagggataattctgggggtggcgttagggagggaagagtagccagggtggtatcctagttacacacagctcattcctgctttattttggggttgtgtgaaattttctattgctatcttt

SEQ ID NO: 193526 - DNA, 813 bp, Homo sapiens
ttgtggagtagaaaggcttctctttatggtacagttcattgagctctaaagtaacttgcctgaaagtcacagagttagttgaaagcagagccaggagcctgagccagaattaaatgaatctagttgaacagggcactaatacagcaattaaacctccatgaattaatcagctttgtaatcaggcacagtcatttttctcttggcaacgtctgggttagagaactattatctgccactgtgttcctgtccctcttgtctagaccgtttgagtgaatgaatagccagttttggaagacccggcactaaggggcattttaaagtttctgttggagaaacgtttatatacactaaatttgtgatggaaataaaagcctttaaagtaggtttatacagttaattgacagacactcttggaacaggtactttagtttcaaaggattaaccatgttccctaacttccttttgaagtcttaatttgccttataaaaaaatccactttctatctttcttgggacttgtggaagaaggtgcttttgttgctataattaagcataaaataagcacattgcatttactgggttgtttccttcgataagccaaggccattgggtttgggggactcagcgcacagctgactactgcaggactactactgtggttatgaccatagtaagtttcaagcgcaaagttactagagggataattctgggggtggcgttagggagggaagagtagccagggtggtatcctagttacacacagctcattcctgctttattttggggttgtgtgaaattttctattgctatcttt

SEQ ID NO: 193527 - DNA, 20 bp, Artificial Sequence
  Antisense oligonucleotide
caccctggctactcttccct

SEQ ID NO: 193528 - DNA, 19 bp, Artificial Sequence
  Antisense oligonucleotide
ggctactcttccctcccta

SEQ ID NO: 193529 - DNA, 21 bp, Artificial Sequence
  Antisense oligonucleotide
tgtgtgtgtgtgtgtgtgtgt

SEQ ID NO: 193530 - DNA, 20 bp, Artificial Sequence
  Antisense oligonucleotide
ttctacccttacccaccttc

SEQ ID NO: 193531 - DNA, 20 bp, Artificial Sequence
  Antisense oligonucleotide
gtcgccttgccttcccatac

SEQ ID NO: 193532 - DNA, 20 bp, Artificial Sequence
  Antisense oligonucleotide
  misc_feature (8)..(8): n is a, c, g, or t
ggtgggtntggaagtgggat

SEQ ID NO: 193533 - DNA, 13 bp, Artificial Sequence
  Antisense oligonucleotide
cggcagccctcgc

SEQ ID NO: 193534 - DNA, 14 bp, Artificial Sequence
  Antisense oligonucleotide
tgggggtgcggggg

SEQ ID NO: 193535 - DNA, 14 bp, Artificial Sequence
  Antisense oligonucleotide
ggacctcggcttct

SEQ ID NO: 193536 - DNA, 14 bp, Artificial Sequence
  Antisense oligonucleotide
gcggcggctgctcg

SEQ ID NO: 193537 - DNA, 14 bp, Artificial Sequence
  Antisense oligonucleotide
ccacccaaagcagc

SEQ ID NO: 193538 - DNA, 14 bp, Artificial Sequence
  Antisense oligonucleotide
ccccccacccaaag

SEQ ID NO: 193539 - DNA, 14 bp, Artificial Sequence
  Antisense oligonucleotide
gcgcagccctgtca

SEQ ID NO: 193540 - DNA, 14 bp, Artificial Sequence
  Antisense oligonucleotide
cgcgcgcagccctg

SEQ ID NO: 193541 - DNA, 14 bp, Artificial Sequence
  Antisense oligonucleotide
cagccaagagcgcg

SEQ ID NO: 193542 - DNA, 14 bp, Artificial Sequence
  Antisense oligonucleotide
ggcccgcgcagccc

SEQ ID NO: 193543 - DNA, 15 bp, Artificial Sequence
  Antisense oligonucleotide
gcccgcagcgccccg

SEQ ID NO: 193544 - DNA, 14 bp, Artificial Sequence
  Antisense oligonucleotide
gaggcgcagagcgc

SEQ ID NO: 193545 - DNA, 14 bp, Artificial Sequence
  Antisense oligonucleotide
cagtgcgcccagag

SEQ ID NO: 193546 - DNA, 14 bp, Artificial Sequence
  Antisense oligonucleotide
gtgctcccaggcag

SEQ ID NO: 193547 - DNA, 14 bp, Artificial Sequence
  Antisense oligonucleotide
ctgcctgggagcac

SEQ ID NO: 193548 - DNA, 14 bp, Artificial Sequence
  Antisense oligonucleotide
aagacctcagctcc

SEQ ID NO: 193549 - DNA, 15 bp, Artificial Sequence
  Antisense oligonucleotide
ttcggatctccaggc

SEQ ID NO: 193550 - DNA, 14 bp, Artificial Sequence
  Antisense oligonucleotide
tgacgtggtgtctc

SEQ ID NO: 193551 - DNA, 14 bp, Artificial Sequence
  Antisense oligonucleotide
ctccccgcgccggt

SEQ ID NO: 193552 - DNA, 14 bp, Artificial Sequence
  Antisense oligonucleotide
atgtcttcacggga

SEQ ID NO: 193553 - DNA, 17 bp, Artificial Sequence
  Antisense oligonucleotide
gccggctgtcgtgtttc

SEQ ID NO: 193554 - DNA, 17 bp, Artificial Sequence
  Antisense oligonucleotide
agcaaggaggcggaacg

SEQ ID NO: 193555 - DNA, 16 bp, Artificial Sequence
  Antisense oligonucleotide
cttcctgccggtaatc

SEQ ID NO: 193556 - DNA, 25 bp, Artificial Sequence
  Antisense oligonucleotide
catgttgcagacccatcgcctttga

SEQ ID NO: 193557 - DNA, 2518 bp, Homo sapiens
ctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaaaaaaaaaaaa

SEQ ID NO: 193558 - DNA, 2949 bp, Homo sapiens
agtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaaaaaaaaaaaa

SEQ ID NO: 193559 - DNA, 1411 bp, Homo sapiens
ccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 193560 - DNA, 993 bp, Homo sapiens
  misc_feature (956)..(956): n is a, c, g, t or u
  misc_feature (968)..(968): n is a, c, g, t or u
ccaggacttatcagctgggataggcctcacttacaagacagctctgttcagtatttggaagaaagcctgacaggtttcttcggaaaagtggccatccatggaatgaatgaaatgttctctttctattccagggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatgtccgtgtttaccttaatattacacctggattaaacagaaaacagtgctgtattttgaagagcgccgaatatgtatgcattttgagaaacccaatctcaccctttccgggttcccaagaactaaaacaagccataacttgagagaaaaaggagaaccttcggggggcaggaaggttgattggaaataacttaaggaaagtctgcagaattcttttttttacaacttttctgagtttccagtgggtatatttagtgtgagtttgacagtaacaggctagggagggcagagattggagaaattgggggtcgggggagtgattatgggaagaaggttagtaaggaacaaaacaatgcaccgttttgtaaagataataaatggaacgtggctggtagatactattcagtacattttcttagggtgagtaagggtagaccaggggaggagggggcggagagagtgttacagaagaaagaaaataagtaaccctgatggtttaagccctttataaaaagaaatggcatcaggttttttttctttantcccccacccancctttgtagtcaagtgcatttaaag

SEQ ID NO: 193561 - DNA, 493 bp, Homo sapiens
aaaaagaaggctgtaagctcagacaacaagtagcaaaagaaacactgaccactcacaggctggggattcagaacctgcggatgtggagggccagagggctgaatttgcaagttgggcaatggggaaagccttcacaaaggagaaagcctttgggctggaattggaggagtaggagtcaatagagagagaagagagtaaagggcaaggccatcattccaggtttagggagcaagtacaaagacacagagaaatggaaggcttggcctgtttggagaatgtcaagctgtctggggttgagagaaagacattctaacaaggcttccattaaagaggctagatttgctgcttggacattttctagctcttctgagacaactttttgttgagttaagcgaaaatgaatgaaaatcagatggaccatatttctcttgaatgcacacgggcttaaaaacgaaggggaaaaagaacttgaccagaatgtgtcttggctttt

SEQ ID NO: 193562 - DNA, 418 bp, Homo sapiens
  misc_feature (359)..(359): n is a, c, g, t or u
ttaagacagggtctcactttgttgcccagactggagtgcagtggagtacaatgatggctcaatgtagcctcgatctactgggccaaagcaatccttctgctccagcctcctaagtggctgggaccacaggcttggaccactgtgccctgttagtttttttatttttagtagagatggggccctgccatgttacccaggctggtcttgaactcctgtcctcaagaaatcctcccgcctctgccgcccagtgtcatgattaaaggcgtgagccaccacacccaactttcaactcccaacccgctccctggcactctctcaggctctgcacatcccagctgtctggaatcactccacacctncatgttcttcaggaacccaggtgcttgaccccctctcccagaccttggcactgtgcctt

SEQ ID NO: 193563 - DNA, 27 bp, Homo sapiens
auaauaaauggaacguggcugguagau

SEQ ID NO: 193564 - DNA, 27 bp, Homo sapiens
cugaguuuccaguggguauauuuagug

SEQ ID NO: 193565 - DNA, 19 bp, Homo sapiens
tgagtggtcagtgtttctt

SEQ ID NO: 193566 - DNA, 21 bp, Homo sapiens
gtgtctttgtacttgctccct

SEQ ID NO: 193567 - DNA, 21 bp, Homo sapiens
ccctttactctcttctctctc

SEQ ID NO: 193568 - DNA, 19 bp, Homo sapiens
ttgctacttgttgtctgag

SEQ ID NO: 193569 - DNA, 19 bp, Homo sapiens
gccatcattgtactccact

SEQ ID NO: 193570 - DNA, 19 bp, Homo sapiens
agttgggtgtggtggctca

SEQ ID NO: 193571 - DNA, 20 bp, Homo sapiens
tggtcccagccacttaggag

SEQ ID NO: 193572 - DNA, 21 bp, Homo sapiens
ggcgggaggatttcttgagga

SEQ ID NO: 193573 - DNA, 20 bp, Homo sapiens
  misc_feature (4)..(4): n is a, c, g, t or u
atgnaggtgtggagtgattc

SEQ ID NO: 193574 - DNA, 13993 bp, Homo sapiens
  ref <308>: DATABASE ACCESSION NUMBER: NM_004006
  ref <309>: DATABASE ENTRY DATE: 2010-08-04
  ref <313>: RELEVANT RESIDUES: (1)..(13993)
tcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccgagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 193575 - DNA, 12436 bp, Homo sapiens
  ref <308>: DATABASE ACCESSION NUMBER: NM_007124
  ref <309>: DATABASE ENTRY DATE: 2010-08-04
  ref <313>: RELEVANT RESIDUES: (1)..(12436)
gtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaa

SEQ ID NO: 193576 - DNA, 378 bp, Homo sapiens
aggttagagaatcgcttgaaccagggaggaggaggtcgcagcaagctgagatcgggccactgcactccaccctgggtgagagagtgagactccatctcaaaaaacaaacaaacaaaaaattaaaaaagaaaaaaacagtggctcaaaatgcataatgcttgcctagagcataacagggaaaaaaggaaaatcagatgcttttagaagactgatacactgaaaactatttgagcgttctgttaatcaataaatcctaaacctaccaatacaaatggaacttatcatgcagccaatccagtaaataatggtagctggaagtaatgatagtgattgtaaaaactatggctgggcatggtggctcatgcctgtaatccgagc

SEQ ID NO: 193577 - DNA, 294 bp, Homo sapiens
ctcaggttctctgcctgcacatctctttcatctggctcctttacatgtcagatgaaagaattatctcaccattccggctcaacaagaaattcagtcccgaacagacaaaaaagtttaaaaatattttataaacattaacctggacttttcgtagaagaaataaagctgagaacgtcatatttcagcagcttcaatacttgttttctgattgaatcataaattttattactttatacttgcttctacaatgacaaagtacccaaagctaaatgtgaatctctagtaggtcggaaa

SEQ ID NO: 193578 - DNA, 686 bp, Homo sapiens
cgtcgaagctcatcaaaaatattgattgaatgacagttaaagagcctttactgtattttaatttccaataaacatatatgtgtcacatatttttaaaaatatggagaagttcagcgtttttgttttgctttactttggtaggttaatgcctgatgttcatcttttccagttcaacaggctgggtgagtggtatggtaccataaaaaggatgatcagctggaaatcaagaccttcaatctctacttccattccctctaacaaacagccatggcatgttgtcatttaattctgagagagcttcatttccacatcttcagaaagacagaacaatgctagatgtacttgcatgtattccaatagtgattgcctttcagaccttcctcttctcccatttgaatagacattagcctcatgagtgacctccgcacctgtactctccccatacacgattctgcatatagccaccaaatgtaactttctaatatgcaaaacataaaaaaaaacttcctggtttttttgaacacattcatctcaattgagcaaggaatcatccatccacattgtatccccagtccacctttcccgcatccttttcaattttttgccaattgcccatatcccaaaacctccaatgagcttgggaagtggggtacgactcgaattcgtatctggcatagtgttctgga

SEQ ID NO: 193579 - DNA, 480 bp, Homo sapiens
ctcaacgctttatactcacatccaattatacttcgcatccaattatacttcatatacaaagtataagctctccagtttgctgtagtcctcatcactccctatccttttttatacgcaactcatctcacttccttatgttatgtttctggcttctacaataggcatttggatttggtgccccccggggtcttgatcacagcttctcaaacttaaatatggatacagcccacctggtgattctgatttaaattcacggggttgggtcgaagaattcagttctaaccagcttccaggtgaaaccaatgttgctgggtcatggatcacactttgaatgacaacgttccaggtaagaatattatttatttgaaaaccactgctagtctacttaaggtatgtgttcgatctattagttactactgctgaaactcagaagatatagatttatgtgacactggcagggaagtataaagcgttgagggg

SEQ ID NO: 193580 - DNA, 501 bp, Homo sapiens
gcccatcaatgggagaaggtctgttatgggaagactgtattgaattaaaaggttaatatcaggctgagctcagtggctcatacctgtaatcccagcactttgggaggttgatgctattactatctctactttactcaggcacagagcagctaagccatttgtccaggttcacagagctagcaggtggccatgcttacacccacagcacctgatactgtctgaaccattccctaaagtatttctacagaagagtactaataagatttttaaatcctgcaggatttttcttattattcttttcaaatattgtgtaatctaataccatgccatccttgatatctaactcattttagagataaaaatgcttaccctaaataccatcatataatctatatttctataaccccaacagcaatattgcaggttagaatccaagtgtgcagaatatttgtgaagatcagtgtagataatactgaaatgacagtgatgaggaagaaggta

SEQ ID NO: 193581 - RNA, 27 nt, Artificial Sequence
  Antisense oligonucleotide
ucucacucucucacccaggguggagug

SEQ ID NO: 193582 - RNA, 27 nt, Artificial Sequence
  Antisense oligonucleotide
agcugcugaaauaugacguucucagcu

SEQ ID NO: 193583 - RNA, 27 nt, Artificial Sequence
  Antisense oligonucleotide
aggcauuaaccuaccaaaguaaagcaa

SEQ ID NO: 193584 - RNA, 27 nt, Artificial Sequence
  Antisense oligonucleotide
gaaaguuacauuugguggcuauaugca

SEQ ID NO: 193585 - RNA, 27 nt, Artificial Sequence
  Antisense oligonucleotide
uacagcaaacuggagagcuuauacuuu

SEQ ID NO: 193586 - RNA, 27 nt, Artificial Sequence
  Antisense oligonucleotide
uuccauuuguauugguagguuuaggau

SEQ ID NO: 193587 - RNA, 27 nt, Artificial Sequence
  Antisense oligonucleotide
cggaauggugagauaauucuuucaucu

SEQ ID NO: 193588 - RNA, 27 nt, Artificial Sequence
  Antisense oligonucleotide
cgugaauuuaaaucagaaucaccaggu

SEQ ID NO: 193589 - RNA, 27 nt, Artificial Sequence
  Antisense oligonucleotide
guaacuaauagaucgaacacauaccuu

SEQ ID NO: 193590 - RNA, 27 nt, Artificial Sequence
  Antisense oligonucleotide
agggaauggaaguagagauugaagguc

SEQ ID NO: 193591 - DNA, 20 bp, Artificial Sequence
  Antisense oligonucleotide
gccacctgctagctctgtga

SEQ ID NO: 193592 - DNA, 19 bp, Artificial Sequence
  Antisense oligonucleotide
taccttcttcctcatcact

SEQ ID NO: 193593 - DNA, 21 bp, Artificial Sequence
  Antisense oligonucleotide
gggattacaggtatgagccac

SEQ ID NO: 193594 - DNA, 21 bp, Artificial Sequence
  Antisense oligonucleotide
ggttcagacagtatcaggtgc

SEQ ID NO: 193595 - DNA, 21 bp, Artificial Sequence
  Antisense oligonucleotide
tcccataacagaccttctccc

SEQ ID NO: 193596 - RNA, 25 nt, Artificial Sequence
  synthetic polynucleotide
cuccacccugggugagagagugaga

SEQ ID NO: 193597 - DNA, 25 bp, Artificial Sequence
  synthetic polynucleotide
cugagaacgucauauuucagcagct

SEQ ID NO: 193598 - DNA, 25 bp, Artificial Sequence
  synthetic polynucleotide
gcuuuacuuugguagguuaaugcct

SEQ ID NO: 193599 - DNA, 25 bp, Artificial Sequence
  synthetic polynucleotide
cauauagccaccaaauguaacuutc

SEQ ID NO: 193600 - DNA, 25 bp, Artificial Sequence
  synthetic polynucleotide
aguauaagcucuccaguuugcugta

SEQ ID NO: 193601 - RNA, 25 nt, Artificial Sequence
  synthetic polynucleotide
ccuaaaccuaccaauacaaauggaa

SEQ ID NO: 193602 - RNA, 25 nt, Artificial Sequence
  synthetic polynucleotide
augaaagaauuaucucaccauuccg

SEQ ID NO: 193603 - RNA, 25 nt, Artificial Sequence
  synthetic polynucleotide
cuggugauucugauuuaaauucacg

SEQ ID NO: 193604 - RNA, 25 nt, Artificial Sequence
  synthetic polynucleotide
gguauguguucgaucuauuaguuac

SEQ ID NO: 193605 - DNA, 25 bp, Artificial Sequence
  synthetic polynucleotide
ccuucaaucucuacuuccauuccct

SEQ ID NO: 193606 - DNA, 10412 bp, Homo sapiens
  ref <308>: DATABASE ACCESSION NUMBER: NM_005502
  ref <309>: DATABASE ENTRY DATE: 2010-08-15
  ref <313>: RELEVANT RESIDUES: (1)..(10412)
gtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccaaaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacagaaa

SEQ ID NO: 193607 - DNA, 1354 bp, Homo sapiens
  ref <308>: DATABASE ACCESSION NUMBER: NM_000229.1
  ref <309>: DATABASE ENTRY DATE: 2010-08-02
  ref <313>: RELEVANT RESIDUES: (1)..(1354)
ccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgt

SEQ ID NO: 193608 - DNA, 14905 bp, Homo sapiens
  ref <308>: DATABASE ACCESSION NUMBER: NM_002332.2
  ref <309>: DATABASE ENTRY DATE: 2010-08-04
  ref <313>: RELEVANT RESIDUES: (1)..(14905)
cagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctgattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagaagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaagttggcaccaacaaatgccgggtgaacaatggcggctgcagcagcctgtgcttggccacccctgggagccgccagtgcgcctgtgctgaggaccaggtgttggacgcagacggcgtcacttgcttggcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccatcagcacacctgcccctcggaccgattcaagtgcgagaacaaccggtgcatccccaaccgctggctctgcgacggggacaatgactgtgggaacagtgaagatgagtccaatgccacttgttcagcccgcacctgcccccccaaccagttctcctgtgccagtggccgctgcatccccatctcctggacgtgtgatctggatgacgactgtggggaccgctctgatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcgaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctggaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatggctcccaatccctgtgaggccaatgggggccagggcccctgctcccacctgtgtctcatcaactacaaccggaccgtgtcctgcgcctgcccccacctcatgaagctccacaaggacaacaccacctgctatgagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggaagctctactggaccgatggtgacaacatcagcatggccaacatggatggcagcaatcgcaccctgctcttcagtggccagaagggccccgtgggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctggaccataagggcaccaacccctgcagtgtcaacaacggtgactgctcccagctctgcctgcccacgtcagagacgacccgctcctgcatgtgcacagccggctatagcctccggagtggccagcaggcctgcgagggcgtaggttcctttctcctgtactctgtgcatgagggaatcaggggaattcccctggatcccaatgacaagtcagatgccctggtcccagtgtccgggacctcgctggctgtcggcatcgacttccacgctgaaaatgacaccatctactgggtggacatgggcctgagcacgatcagccgggccaagcgggaccagacgtggcgtgaagacgtggtgaccaatggcattggccgtgtggagggcattgcagtggactggatcgcaggcaacatctactggacagaccagggctttgatgtcatcgaggtcgcccggctcaatggctccttccgctacgtggtgatctcccagggtctagacaagccccgggccatcaccgtccacccggagaaagggtacttgttctggactgagtggggtcagtatccgcgtattgagcggtctcggctagatggcacggagcgtgtggtgctggtcaacgtcagcatcagctggcccaacggcatctcagtggactaccaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggactcatgccaacggctctatcaagcgcgggagcaaagacaatgccacagactccgtgcccctgcgaaccggcatcggcgtccagcttaaagacatcaaagtcttcaaccgggaccggcagaaaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaaacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaacctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgaactctctccatgccgaatcaacaacggtggctgccaggacctgtgtctgctcactcaccagggccatgtcaactgctcatgccgagggggccgaatcctccaggatgacctcacctgccgagcggtgaattcctcttgccgagcacaagatgagtttgagtgtgccaatggcgagtgcatcaacttcagcctgacctgcgacggcgtcccccactgcaaggacaagtccgatgagaagccatcctactgcaactcccgccgctgcaagaagactttccggcagtgcagcaatgggcgctgtgtgtccaacatgctgtggtgcaacggggccgacgactgtggggatggctctgacgagatcccttgcaacaagacagcctgtggtgtgggcgagttccgctgccgggacgggacctgcatcgggaactccagccgctgcaaccagtttgtggattgtgaggacgcctcagatgagatgaactgcagtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgtgaaacgccccagatgccctctgaattacttcgcctgccctagtgggcgctgcatccccatgagctggacgtgtgacaaagaggatgactgtgaacatggcgaggacgagacccactgcaacaagttctgctcagaggcccagtttgagtgccagaaccatcgctgcatctccaagcagtggctgtgtgacggcagcgatgactgtggggatggctcagacgaggctgctcactgtgaaggcaagacgtgcggcccctcctccttctcctgccctggcacccacgtgtgcgtccccgagcgctggctctgtgacggtgacaaagactgtgctgatggtgcagacgagagcatcgcagctggttgcttgtacaacagcacttgtgacgaccgtgagttcatgtgccagaaccgccagtgcatccccaagcacttcgtgtgtgaccacgaccgtgactgtgcagatggctctgatgagtcccccgagtgtgagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggacgacggccggacgtgtgctgatgtggacgagtgcagcaccaccttcccctgcagccagcgctgcatcaacactcatggcagctataagtgtctgtgtgtggagggctatgcaccccgcggcggcgacccccacagctgcaaggctgtgactgacgaggaaccgtttctgatcttcgccaaccggtactacctgcgcaagctcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaa

SEQ ID NO: 193609 - DNA, 14907 bp, Mus musculus
  ref <308>: DATABASE ACCESSION NUMBER: NM_008512.2
  ref <309>: DATABASE ENTRY DATE: 2010-05-16
  ref <313>: RELEVANT RESIDUES: (1)..(14907)
agtcaggggagcagcggtgcgagctccaggccagtgcactgaggaggcggaaacgggggagcccctagtgctccatcaggcccctaccaaggcacccccatcgggtccacgccccccaccccccaccccgcctcctcccaattgtgcatttttgcagccagaggcggctccgagatggggctgtgagcttcgccctgggagggggagaggagcgaggagtaaagcaggggtgaagggttcgaatttgggggcagggggcgcacccgcgtcagcaggcccttcccagggggctcggaactgtaccatttcacctatgcccctggttcgctttgcttaaggaaaggataagaatagaagagtcggggagaggaagataaagggggaccccccaattggggggggcgaggacaagaagtaacaggaccagagggtgggggctgctgtttgcatcggcccacaccatgctgaccccgccgttgctgctgctgctgccgctgctttcagctctggtctccggggccactatggatgcccctaaaacttgcagccctaagcagtttgcctgcagagaccaaatcacctgtatctcaaagggctggcggtgtgacggtgaaagagattgccccgacggctctgatgaagcccctgagatctgtccacagagtaaagcccagagatgcccgccaaatgagcacagttgtctggggactgagctatgtgtccccatgtctcgtctctgcaacgggatccaggactgcatggatggctcagacgagggtgctcactgccgagagctccgagccaactgttctcgaatgggttgtcaacaccattgtgtacctacacccagtgggcccacgtgctactgtaacagcagcttccagctgcaggcagatggcaagacgtgcaaagattttgacgagtgttccgtgtatggcacctgcagccagctttgcaccaacacagatggctccttcacatgtggctgtgttgaaggctacctgctgcaaccggacaaccgctcctgcaaggccaagaatgagccagtagatcggccgccagtgctactgattgccaactctcagaacatcctagctacgtacctgagtggggcccaagtgtctaccatcacacccaccagcacccgacaaaccacggccatggacttcagttatgccaatgagaccgtatgctgggtgcacgttggggacagtgctgcccagacacagctcaagtgtgcccggatgcctggcctgaagggctttgtggatgagcataccatcaacatctccctcagcctgcaccacgtggagcagatggcaatcgactggctgacgggaaacttctactttgtcgacgacattgacgacaggatctttgtctgtaaccgaaacggggacacctgtgtcactctgctggacctggaactctacaaccccaaaggcatcgccttggaccccgccatggggaaggtgttcttcactgactacgggcagatcccaaaggtggagcgctgtgacatggatggacagaaccgcaccaagctggtggatagcaagatcgtgtttccacacggcatcaccctggacctggtcagccgcctcgtctactgggcggacgcctacctagactacatcgaggtggtagactacgaagggaagggtcggcagaccatcatccaaggcatcctgatcgagcacctgtacggcctgaccgtgtttgagaactatctctacgccaccaactcggacaatgccaacacgcagcagaagacgagcgtgatccgagtgaaccggttcaacagtactgagtaccaggtcgtcacccgtgtggacaagggtggtgccctgcatatctaccaccagcgacgccagccccgagtgcggagtcacgcctgtgagaatgaccagtacgggaagccaggtggctgctccgacatctgcctcctggccaacagtcacaaggcaaggacctgcaggtgcaggtctggcttcagcctgggaagtgatgggaagtcttgtaagaaacctgaacatgagctgttcctcgtgtatggcaagggccgaccaggcatcattagaggcatggacatgggggccaaggtcccagatgagcacatgatccccatcgagaaccttatgaatccacgcgctctggacttccacgccgagaccggcttcatctactttgctgacaccaccagctacctcattggccgccagaaaattgatggcacggagagagagactatcctgaaggatggcatccacaatgtggagggcgtagccgtggactggatgggagacaatctttactggactgatgatggccccaagaagaccattagtgtggccaggctggagaaagccgctcagacccggaagactctaattgagggcaagatgacacaccccagggccattgtagtggatccactcaatgggtggatgtactggacagactgggaggaggaccccaaggacagtcggcgagggcggctcgagagggcttggatggacggctcacaccgagatatctttgtcacctccaagacagtgctttggcccaatgggctaagcctggatatcccagccggacgcctctactgggtggatgccttctatgaccgaattgagaccatactgctcaatggcacagaccggaagattgtatatgagggtcctgaactgaatcatgccttcggcctgtgtcaccatggcaactacctcttttggaccgagtaccggagcggcagcgtctaccgcttggaacggggcgtggcaggcgcaccgcccactgtgacccttctgcgcagcgagagaccgcctatctttgagatccgaatgtacgacgcgcagcagcagcaagtgggtaccaacaaatgccgggtaaataacggaggctgcagcagcctgtgcctcgccacccccgggagccgccagtgtgcctgtgccgaggaccaggtgttggacacagatggtgtcacctgcttggcgaacccatcctacgtgcccccaccccagtgccagccgggcgagtttgcctgtgccaacaaccgctgcatccaggagcgctggaagtgtgacggagacaacgactgtctggacaacagcgatgaggccccagcactgtgccatcaacacacctgtccctcggaccgattcaagtgtgagaacaaccggtgtatccccaaccgctggctctgtgatggggataatgattgtggcaacagcgaggacgaatccaatgccacgtgctcagcccgcacctgtccacccaaccagttctcctgtgccagtggccgatgcattcctatctcatggacctgtgatctggatgatgactgtggggaccggtccgatgagtcagcctcatgcgcctaccccacctgcttccccctgactcaatttacctgcaacaatggcagatgtattaacatcaactggcggtgtgacaacgacaatgactgtggggacaacagcgacgaagccggctgcagtcactcctgctccagtacccagttcaagtgcaacagtggcagatgcatccccgagcactggacgtgtgatggggacaatgattgtggggactacagcgacgagacacacgccaactgtaccaaccaggctacaagacctcctggtggctgccactcggatgagttccagtgccgcctagatggcctgtgcatccccctgaggtggcgctgcgacggggacaccgactgcatggattccagcgatgagaagagctgtgagggcgtgacccatgtttgtgacccgaatgtcaagtttggctgcaaggactccgcccggtgcatcagcaaggcgtgggtgtgtgatggcgacagcgactgtgaagataactccgacgaggagaactgtgaggccctggcctgcaggccaccctcccatccctgcgccaacaacacctctgtctgcctgcctcctgacaagctgtgcgacggcaaggatgactgtggagacggctcggatgagggcgagctctgtgaccagtgttctctgaataatggtggctgtagtcacaactgctcagtggcccctggtgaaggcatcgtgtgctcttgccctctgggcatggagctgggctctgacaaccacacctgccagatccagagctactgtgccaagcacctcaaatgcagccagaagtgtgaccagaacaagttcagtgtgaagtgctcctgctacgagggctgggtcttggagcctgacggggaaagctgccgcagtctggatcccttcaaaccgttcatcatcttctccaaccgccacgagatcaggcgcattgaccttcacaagggggactacagcgtcctagtgcctggcctgcgcaacactattgccctggacttccacctcagccagagtgccctctactggaccgacgtggtagaggacaagatctaccgtgggaaactcctggacaacggagccctgaccagctttgaggtggtgattcagtatggcttggccacaccagagggcctggctgtagattggattgcaggcaacatctactgggtggagagcaacctggaccagatcgaagtggccaagctggacggaaccctccgaaccactctgctggcgggtgacattgagcacccgagggccatcgctctggaccctcgggatgggattctgttttggacagactgggatgccagcctgccacgaatcgaggctgcgtccatgagtggggctggccgccgaaccatccaccgggagacaggctctgggggctggcccaacgggctcaccgtggattacctggagaagcgcatcctctggattgatgctaggtcagatgccatctattcagcccggtatgacggctccggccacatggaggtgcttcggggacacgagttcctgtcacacccatttgccgtgacactgtacggtggggaggtgtactggaccgactggcgaacaaatacactggctaaggccaacaagtggactggccacaacgtcaccgtggtacagaggaccaacacccagcccttcgacctgcaggtgtatcacccttcccggcagcccatggctccaaacccatgtgaggccaatggcggccggggcccctgttcccatctgtgcctcatcaactacaaccggaccgtctcctgcgcctgtccccacctcatgaagctgcacaaggacaacaccacctgctatgagtttaagaagttcctgctgtacgcacgtcagatggagatccggggcgtggacctggatgccccgtactacaattatatcatctccttcacggtgcctgatatcgacaatgtcacggtgctggactatgatgcccgagagcagcgagtttactggtctgatgtgcggactcaagccatcaaaagggcatttatcaacggcactggcgtggagaccgttgtctctgcagacttgcccaacgcccacgggctggctgtggactgggtctcccgaaatctgttttggacaagttacgacaccaacaagaagcagattaacgtggcccggctggacggctccttcaagaatgcggtggtgcagggcctggagcagccccacggcctggtcgtccacccgcttcgtggcaagctctactggactgatggggacaacatcagcatggccaacatggatgggagcaaccacactctgctcttcagtggccagaagggccctgtggggttggccattgacttccctgagagcaaactctactggatcagctctgggaaccacacaatcaaccgttgcaatctggatgggagcgagctggaggtcatcgacaccatgcggagccagctgggcaaggccactgccctggccatcatgggggacaagctgtggtgggcagatcaggtgtcagagaagatgggcacgtgcaacaaagccgatggctctgggtccgtggtgctgcggaacagtaccacgttggttatgcacatgaaggtgtatgacgagagcatccagctagagcatgagggcaccaacccctgcagtgtcaacaacggagactgttcccagctctgcctgccaacatcagagacgactcgctcctgtatgtgtacagccggttacagcctccggagcggacagcaggcctgtgagggtgtgggctcttttctcctgtactctgtacatgagggaattcgggggattccactagatcccaatgacaagtcggatgccctggtcccagtgtccggaacttcactggctgtcggaatcgacttccatgccgaaaatgacactatttattgggtggatatgggcctaagcaccatcagcagggccaagcgtgaccagacatggcgagaggatgtggtgaccaacggtattggccgtgtggagggcatcgcggtggactggatcgcaggcaacatatactggacggaccagggcttcgatgtcatcgaggttgcccggctcaatggctcttttcgttatgtggtcatttcccagggtctggacaagcctcgggccatcactgtccacccagagaaggggtacttgttctggaccgagtggggtcattacccacgtattgagcggtctcgccttgatggcacagagagagtggtgttggttaatgtcagcatcagctggcccaatggcatctcagtagactatcagggcggcaagctctactggtgtgatgctcggatggacaagatcgagcgcatcgacctggaaacgggcgagaaccgggaggtggtcctgtccagcaataacatggatatgttctccgtgtccgtgtttgaggacttcatctactggagtgacagaactcacgccaatggctccatcaagcgcggctgcaaagacaatgctacagactccgtgcctctgaggacaggcattggtgttcagcttaaagacatcaaggtcttcaacagggacaggcagaagggtaccaatgtgtgcgcggtagccaacggcgggtgccagcagctctgcttgtatcggggtggcggacagcgagcctgtgcctgtgcccacgggatgctggcagaagacggggcctcatgccgagagtacgctggctacctgctctactcagagcggaccatcctcaagagcatccacctgtcggatgagcgtaacctcaacgcaccggtgcagccctttgaagaccccgagcacatgaaaaatgtcatcgccctggcctttgactaccgagcaggcacctccccggggacccctaaccgcatcttcttcagtgacatccactttgggaacatccagcagatcaatgacgatggctcgggcaggaccaccatcgtggaaaatgtgggctctgtggaaggcctggcctatcaccgtggctgggacacactgtactggacaagctacaccacatccaccatcacccgccacaccgtggaccagactcgcccaggggccttcgagagggagacagtcatcaccatgtccggagacgaccacccgagagcctttgtgctggatgagtgccagaacctgatgttctggaccaattggaacgagctccatccaagcatcatgcgggcagccctatccggagccaacgtcctgaccctcattgagaaggacatccgcacgcccaatgggttggccatcgaccaccgggcggagaagctgtacttctcggatgccaccttggacaagatcgagcgctgcgagtacgacggctcccaccgctatgtgatcctaaagtcggagcccgtccacccctttgggttggcggtgtacggagagcacattttctggactgactgggtgcggcgggctgtgcagcgagccaacaagtatgtgggcagcgacatgaagctgcttcgggtggacattccccagcaacccatgggcatcatcgccgtggccaacgacaccaacagctgtgaactctccccctgccgtatcaacaatggaggctgccaggatctgtgtctgctcacccaccaaggccacgtcaactgttcctgtcgagggggccggatcctccaggaggacttcacctgccgggctgtgaactcctcttgtcgggcacaagatgagtttgagtgtgccaatggggaatgtatcagcttcagcctcacctgtgatggcgtctcccactgcaaggacaagtccgatgagaagccctcctactgcaactcacgccgctgcaagaagactttccgccagtgtaacaatggtcgctgtgtatccaacatgctgtggtgcaatggggtggatgactgtggggatggctctgatgagattccttgcaacaagactgcctgtggtgtgggtgagttccgctgccgggatgggtcctgcatcgggaactccagtcgctgcaaccagtttgtggattgtgaggatgcctcggatgagatgaattgcagtaccacagactgcagcagctatttccgcctgggcgtgaaaggtgtcctcttccagccgtgcgagcggacatccctgtgctacgcacctagctgggtgtgtgatggcgccaacgactgtggagactacagcgatgaacgtgactgtccaggtgtgaagcgccctaggtgcccgctcaattactttgcctgccccagcgggcgctgtatccccatgagctggacgtgtgacaaggaggatgactgtgagaacggcgaggacgagacccactgcaacaagttctgctcagaggcacagttcgagtgccagaaccaccggtgtatctccaagcagtggctgtgtgacggtagcgatgattgcggggatggctccgatgaggcagctcactgtgaaggcaagacatgtggcccctcctccttctcctgtcccggcacccacgtgtgtgtccctgagcgctggctctgtgatggcgacaaggactgtaccgatggcgcggatgagagtgtcactgctggctgcctgtacaacagcacctgtgatgaccgtgagttcatgtgccagaaccgcttgtgtattcccaagcatttcgtgtgcgaccatgaccgtgactgtgctgatggctctgatgaatcccctgagtgtgagtacccaacctgcggccccaatgaattccgctgtgccaatgggcgttgtctgagctcccgtcagtgggaatgtgatggggagaatgactgtcacgaccacagcgatgaggctcccaagaacccacactgcaccagcccagagcacaaatgcaatgcctcatcacagttcctgtgcagcagcgggcgctgcgtggctgaggcgttgctctgcaacggccaggacgactgtggggacggttcagacgaacgcgggtgccatgtcaacgagtgtctcagccgcaagctcagtggctgcagtcaggactgcgaggacctcaagataggctttaagtgccgctgtcgcccgggcttccggctaaaggacgatggcaggacctgtgccgacctggatgagtgcagcaccaccttcccctgcagccagctctgcatcaacacccacggaagttacaagtgtctgtgtgtggagggctatgcaccccgtggcggtgacccccacagctgcaaagctgtgaccgatgaggagccatttctcatctttgccaaccggtactacctgcggaagctcaacctggacggctccaactacacactgcttaagcagggcctgaacaatgcggtcgccttggactttgactaccgagagcagatgatctactggacggacgtgaccacccagggcagcatgattcgcaggatgcacctcaacggcagcaacgtgcaggttctgcaccggacgggccttagtaacccagatgggctggctgtggactgggtgggtggcaacctgtactggtgtgacaagggcagagataccattgaggtgtccaagcttaacggggcctatcggacagtgctggtcagctctggcctccgggagcccagagctctggtagtggatgtacagaatgggtacctgtactggacagactggggtgaccactcactgatcggccggattggcatggatggatctggccgcagcatcatcgtggacactaagatcacatggcccaatggcctgaccgtggactacgtcacggaacgcatctactgggctgacgcccgtgaggactacatcgagttcgccagcctggatggctccaaccgtcacgttgtgctgagccaagacatcccacacatctttgcgctgaccctatttgaagactacgtctactggacagactgggaaacgaagtccatcaaccgggcccacaagaccacgggtgccaacaaaacactcctcatcagcaccctgcaccggcccatggacttacatgtattccacgccctgcgccagccagatgtgcccaatcacccctgcaaagtcaacaatggtggctgcagcaacctgtgcctgctgtcccctgggggtggtcataaatgcgcctgccccaccaacttctatctgggtggcgatggccgtacctgtgtgtccaactgcacagcaagccagtttgtgtgcaaaaatgacaagtgcatccccttctggtggaagtgtgacacggaggacgactgtggggatcactcagacgagcctccagactgtcccgagttcaagtgccgcccaggccagttccagtgctccaccggcatctgcaccaaccctgccttcatctgtgatggggacaatgactgccaagacaatagtgatgaggccaattgcgacattcacgtctgcttgcccagccaattcaagtgcaccaacaccaaccgctgcattcctggcatcttccgttgcaatgggcaggacaactgcggggacggcgaggatgagcgggattgccctgaggtgacctgcgcccccaaccagttccagtgctccatcaccaagcgctgcatccctcgcgtctgggtctgtgacagggataatgactgtgtggacggcagtgatgagcctgccaactgtacccaaatgacctgtggagtggatgagttccgctgcaaggattctggccgctgcatccccgcgcgctggaagtgtgacggagaagatgactgtggggatggttcagatgagcccaaggaagagtgtgatgagcgcacctgtgagccataccagttccgctgcaaaaacaaccgctgtgtcccaggccgttggcaatgtgactacgacaacgactgcggagataactcggacgaggagagctgcacacctcggccctgctctgagagtgagttttcctgtgccaatggccgctgcatcgctgggcgctggaagtgtgatggggaccatgactgtgccgacggctcagacgagaaagactgcaccccccgctgtgatatggaccagttccagtgcaagagtggccactgcatccccctgcgctggcgctgtgacgcggatgctgactgtatggacggcagtgacgaggaagcctgtggcactggggtgaggacctgcccattggatgagtttcaatgtaacaacaccttgtgcaagccgctggcctggaagtgtgatggagaggacgactgtggggacaactcagatgagaaccccgaggaatgcgcccggttcatctgccctcccaaccggcctttccgctgcaagaatgaccgagtctgcctgtggattgggcgccagtgtgatggcgtggacaactgtggagatgggactgacgaggaggactgtgagccccccacggcccagaacccccactgcaaagacaagaaggagttcctgtgccgaaaccagcgctgtctatcatcctccctgcgctgtaacatgttcgatgactgcggcgatggctccgatgaagaagattgcagcatcgaccccaagctgaccagctgtgccaccaatgccagcatgtgtggggacgaagctcgttgtgtgcgcactgagaaagctgcctactgtgcctgccgctcgggcttccatactgtgccgggccagcccggatgccaggacatcaacgagtgcctgcgctttggtacctgctctcagctctgcaacaacaccaagggaggccacctctgcagctgtgcccgcaacttcatgaagacacacaacacctgcaaagctgaaggctccgagtaccaggtgctatacatcgcggatgacaacgagatccgcagcttgttcccgggccacccccactcagcctacgagcagacattccagggcgatgagagtgtccgcatagatgccatggatgtccatgtcaaggccggccgtgtctactggactaactggcacacgggcacaatctcctacaggagcctgccccctgccgcccctcctaccacttccaaccgccaccggaggcagatcgaccggggtgtcacccacctcaatatttcagggctgaagatgccgaggggtatcgctatcgactgggtggccgggaatgtgtactggaccgattccggccgagacgtgattgaggtggcgcaaatgaagggcgagaaccgcaagacgctcatctcgggcatgattgatgagccccatgccatcgtggtggaccctctgaggggcaccatgtactggtcagactgggggaaccaccccaagattgaaacagcagcgatggatggcacccttcgggagactctcgtgcaagacaacattcagtggcctacagggctggctgtggactatcacaatgaacggctctactgggcagatgccaagctttcggtcatcggcagcatccggctcaacggcactgaccccattgtggctgctgacagcaaacgaggcctaagtcaccccttcagcatcgatgtgtttgaagactacatctacggagtcacttacatcaataatcgtgtcttcaagatccacaagtttggacacagccccttgatcaacctaactgggggcctgagccatgcctctgatgtagtcctttaccatcaacacaagcagcctgaagtgaccaacccctgtgaccgcaagaaatgtgaatggctgtgtctgctgagccccagcgggcctgtctgcacctgtcccaatggaaagaggctggataatggcacctgtgtgcctgtgccctctccaacaccccctccagatgcccctaggcctggaacctgcactctgcagtgcttcaatggtggtagttgtttcctcaatgctcggaggcagcccaagtgccgttgccagccccgttacacaggcgataagtgtgagctggatcagtgctgggaatactgtcacaacggaggcacctgtgcggcttccccatctggcatgcccacgtgccgctgtcccactggcttcacgggccccaaatgcaccgcacaggtgtgtgcaggctactgctctaacaacagcacctgcaccgtcaaccagggcaaccagccccagtgccgatgtctacctggcttcctgggcgaccgttgccagtaccggcagtgctctggcttctgtgagaactttggcacctgtcagatggctgctgatggctcccgacaatgtcgctgcaccgtctactttgagggaccaaggtgtgaggtgaacaagtgtagtcgctgtctccaaggcgcctgtgtggtcaataagcagaccggagatgtcacatgcaactgcactgatggccgggtagcccccagttgtctgacctgcatcgatcactgtagcaatggtggctcctgcaccatgaacagcaagatgatgcctgagtgccagtgcccgccccatatgacaggaccccggtgcgaggagcaggttgttagtcagcaacagcctgggcatatggcctccatcctgatccctctgctgctgcttctcctgctgcttctggtggctggcgtggtgttctggtataagcggcgagtccgaggggctaagggcttccagcaccagcggatgaccaatggggccatgaatgtggaaattggaaaccctacctacaagatgtatgaaggtggagagcccgatgatgtcgggggcctactggatgctgattttgcccttgaccctgacaagcctaccaacttcaccaacccagtgtatgccacgctctacatggggggccacggcagccgccattccctggccagcacggacgagaagcgagaactgctgggccggggacctgaagacgagataggagatcccttggcatagggccctgccccgacggatgtccccagaaagccccctgccacatgagtctttcaatgaaccccctccccagccggcccttctccggccctgccgggtgtacaaatgtaaaaatgaaggaattactttttatatgtgagcgagcaagcgagcaagcacagtattatctctttgcatttccttcctgcctgctcctcagtatcccccccatgctgccttgagggggcggggagggctttgtggctcaaaggtatgaaggagtccacatgttccctaccgagcatacccctggaagctggcggcacggcctccccaccacgcctgtgcaagacactcaacggggctccgtgtcccagctttcctttccttggctctctggggttagttcaggggaggtggagtcctctgctgaccctgtctggaagatttggctctagctgaggaaggagtcttttagttgagggaagtcaccccaaaccccagctcccactttcaggggcacctctcagatggccatgctcagtatcccttccagacaggccctcccctctctagcgccccctctgtggctcctagggctgaacacattctttggtaactgtcccccaagcctcccatccccctgagggccaggaagagtcggggcacaccaaggaagggcaagcgggcagccccattttggggacgtgaacgttttaataatttttgctgaattcctttacaactaaataacacagatattgttataaataaaattgtaaaaaaggaaaaaaaaaagaaaagaaaagaaaagaaaaaaaaaaaaaaaaaa

SEQ ID NO: 193610 - DNA, 5265 bp, Homo sapiens
  ref <308>: DATABASE ACCESSION NUMBER: NM_000527
  ref <309>: DATABASE ENTRY DATE: 2010-08-01
  ref <313>: RELEVANT RESIDUES: (1)..(5265)
acatttgaaaatcaccccactgcaaactcctccccctgctagaaacctcacattgaaatgctgtaaatgacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaatttgtctaaa

SEQ ID NO: 193611 - DNA, 1223 bp, Homo sapiens
  ref <308>: DATABASE ACCESSION NUMBER: NM_000041.2
  ref <309>: DATABASE ENTRY DATE: 2010-08-15
  ref <313>: RELEVANT RESIDUES: (1)..(1223)
gggatccttgagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcaaaaaaaaaaaaaaaaaaaaaaaaaaaaaaaaaaaaaaaaaaaa

SEQ ID NO: 193612 - DNA, 897 bp, Homo sapiens; identical to SEQ ID NO: 193207
  ref <308>: DATABASE ACCESSION NUMBER: NM_000039
  ref <309>: DATABASE ENTRY DATE: 2010-08-15
  ref <313>: RELEVANT RESIDUES: (1)..(897)

SEQ ID NO: 193613 - DNA, 1299 bp, Homo sapiens
acgcccgggaacccccgacccctctgagcccggggtactgcgcccgggtctccacgcccagagatgctccccggtctccaccgtcgggcaagccccaagcgcagcagcgcagagtcctggggtcaccagagctcgtactaggacatcgtctccccatttaacaccgcctccggtcccatctgagttgcaagtggtggggatgtggggctccggatcaaagtccccgaaaccgagcacttcccgaagcctccttggcctcgaaacaaaacaataacgcccaactccatcatattccagaactcccaccacctgcatacagacattcagctgcacaagccccctccatgctacagtcaacaggatctccaggccacggctcaagcccaggtactcacatcagtggttctatcaacactcaggacagacccatagaagaggcccaagcaggccctggaagtgcatgtggaggccaccaggcaaggaattctggagtcccaggtactcataactctgggtggcatggcccctttgcaccatggactgtttgcccttagaaagggatggatctgagctgggcgcagtggctcatgcctgtaatcccagcactttgggaggccaaggtgggcagctcacctcaggtcaggttggtctcaaactcctgacctcaggcgatccacctcagcctctcaaagtgctggaattataggtgtgagccactgtgcccagcccaaaatcattctttttggaattttgaagcatataattccaaaaggtatgaaggtaatcacttagattgctctaataagggaatgggaacagttaagtcctatacaaataagacaaagataagatactacaaaaaggggatgagcccaagaaaaaaatcaaagtcccagagagagaacagccattgattctaaatacacaagtctatggccccaacccaaacttgtttcactaagaacaacctgtggtttcgagaatctggtcatcccccacagtgaatacatgaacacattgtaatgtttgaaatgtttatttttcttgttgatttcttactgttagaagagctaagtgatttggcccaaagtggctaagtgattcggccagtttgtacacagggatataagtttgctgacaccaagctcatactttacaaatgtaatatcttcataaaacaaaaatactgggccgggcgcggtggctcacgcctgtaatcccagcattttgggaggccgaggcgggcggatcatgagatcaggagatcgagaccatcctggctagcagggtgaagccccg

SEQ ID NO: 193614 - DNA, 917 bp, Mus musculus
caaaatggcgtgctaccctgtccaaccttgtctgtagacagagtcaattgaacactgtctttgggacttccgtgcaactgaggtgggcgggcttgaagcacaaagctttcagggagaaccaaactttatgcccaagctgctctctgccacccacagggtaaatgaatctcatacaggaaaggcaagagacatgtgacactgttgtctgatggtcacaagtcaagctttttaaaaagcagcctgatattgtgagctaacatggctttctgtaattgaatgcaatgtattttctatgcttgtctgggtaaagttgaccttggtttgatttagctcaagcaatatttcaacagtgcactggggctctgagtcccctgactactgtttgactagagccaggctctgccctggatggcaaccaacagcccaggctctggggcacagccgggctttgacaggtctggggaaatgttcaccggagatgaaaggtttcaaactatgaaactctaaaatctcaagtcaaaacttttgacaagcacacacaggacatgaattacaatcacccgaagatttttacaggcttctcaattttaatgacatgctgacacgtgtcatcagatctcacaacaagatgacacatgggtgtcaggtatggcgcagaagactagagtcggggtgtaaccaatgagcattgtctgttggacacaggcgaattcggcaaacggacagtgctggaggcagaagggtttaaagaaggcaggaaagcccatgtttaacagaatggggtgacgaagagggatgggaaggtctaactcacccgggggtgggggcaccaggggggcccacggacacagaaaaccacgcaggtcaggcacctacaaagaccgaaggaaaaagggaccacgcagaaatcactcacg

SEQ ID NO: 193615 - DNA, 1550 bp, Homo sapiens
aaagtccaaggtgggaacagataggtctgggggcatgggggctgggcctaataggggccgggcatggatgggcctctcctgctcaccgatcctgggctgggcatcttgtccttggtgggtgggggccaaggaaggagtggtggggcttggcccagagtctggtgtggctgtgactgaccacagcttgtgatgccccagccaagacctcaggcacaccccgtcccccactccgccccccctgggttagacaactgagagtcacagtgtggtgggagaagggacgtcattcctctaagggacaagcttttggcccctccccacaccagggcaggtacttatgtcggggcttatgcagggcagaagggctttggccaggtcagctgccaggggctggggcccaggctccccagggtctggcgtggtgcatcaggggcctggtgggggcttaccgaggatgacgggccgtgtgtggttactgagctcagccttgggcgtggtgtgcggggggaagagcacattgaggagccagaagggggcggcaggagggagcagcagccccagcagcagcgtcacccactgccatggggagccgggcggccccattccagccctggtgcctactgccagagaaagcggcactgggctgtccttatctggtgtgggagtgggaggggccctagggccagtgggagggacggcctggccagtgggggttgtggccagagattgccggaaaggggcacagcctcagggagccggctctgggcctgggttcagttccgccttcttctcttggcgccaggggaaacagagccggggcagcaggaggcccagaactacacaatgttttattgaaaaagtcaggcctcagctcagctgtctccattcggctcagcttggtggggggccctgcccatagtagactgagccagatcttcctgcaggcagctgggctggactccctccctggctacccttcccttcgtctctgatggtgacatccaaacaataaatatgcaataaatagcgctcctgggctgggccgggccggctgccttcaaaccccactcggcccctaccagtcttctctggccaggacaggcctactggggtgctagatagtaaagtccccaaacatcccagggtcccacaagacctgggatccatctccattttgaggcccaggcctggtttccaaggagacctagcaaagctgggtccaggacagggccaggcaagcagggctggcaggtgggtgctgggaagaggctgttaccccagaccacagcttgttatgtcctggccaagacctcgactccaggccacaagatgacactgggctcaggagtagatggtgatgacttcacggccaccaccgcgcaccaacagcacccgctcaaggccctcggtcagcacctcgaggaactccatgtagttctcgtcgccctcactgttcctgggtgggccaggcatgtttaggagaaccaggcgggcgtcgtgggagcgcgtgacaatgacttcattgagcttcacagcagtgtgcatgcgcc

SEQ ID NO: 193616 - DNA, 329 bp, Homo sapiens
  misc_feature (6)..(6): n is a, c, g, or t
  misc_feature (134)..(134): n is a, c, g, or t
  misc_feature (311)..(311): n is a, c, g, or t
  misc_feature (327)..(327): n is a, c, g, or t
tttaangtttgatgtttattggtggtgtctgatgagcgtttctcttgtccagactgtgtttctctctccagaccagctcccagggtacagggggtggggagtaggtggtagctgtgtcagtgctgggccctggngccactccctagggaagagcaggtggggcctcggggggtctggccctagctctggcagatccatcctcagtgaagcacatccctggggcaaaggcactcctgaggccaagaccagcatgggcttgatggagccaccccagggagccccaagagagatgaagccatcaataaagcggnccttccaggcctgggnct

SEQ ID NO: 193617 - DNA, 1826 bp, Homo sapiens
tgtcactctgacctcagtgtaggcactgcctcctctgggaagtctttgctgacctgaaaggctcagcctcttgtgcttcctaagcttttctcagagcatttagcttcattagtaattaaacttccattagtgaaatgatctgattaatggttgtcactcccagattttaattctaacttttttttttttttttttttttgagacccagtctctttttttttgagacagtctcattctgccgcccagtctggagtgcaacgacgtgatctcggctcacggtgacctccacctcccaggttcaagtgattctcgtgcctcagcctcctgagtagctgggacgacagatgcatgccaccacgcctggcaaatattttgtattttagtagagacgggggtttctgccgtgttggcctggctggtctcaaactcctgagttcgggtgatccgcctgcctcggtctcccggggtgccgggattacaggcgtgagccaccgtgcccggcctctaaacacttgtggccctgtcattcacccagcactcaaaaggtcgtctcacctgcccttttgggagctgggagagacagctcaaattgtcaccgcccccccaccgccccgtgctcctctgacagggctgtgggtggagccagctccagtccccgcgcccagcacagaggcaggcacggtgcacactgcctcaacagctcgaccaggagagtgggcagctgtacatctagggtgcccagctcagtcccaggcctcagcagagcccatcttgcctcactgcacacagcactgagcctgtggctggtgaggagtgaaacctagtgtgggactctagtgcctcccttcaacctgaaacatagccatcagggcttacggtagcaaaggaaggtctttattcaggaggcgggggctctgggctggcagtcggggatgcagggggaccctggcggtaggcacccagcaggatggcattgatgtgctccagggtcaggttgctgaagaccatgttcagatgctgtatcccgtgcaggggcagcaggtgcacaggctgtggctggcggccctgccacaggccacagagctcggtgctgcgggtcgccaccgtgtcatcaccatcctcatagagcacacccacagggtccgtgtaggggaagccgtggtcgtagatgtaggtgcggggcgtgggcaggcccacgccgtaaagacagtatacttccacaccaggtgctgggagtcctgccaggaggtcacgtgactgcagccacatgtaccagccttcctcaaagtgcaggtctgcaaagaagcgttggaagtcacggcctgtgtagttgaagctgggtgtggaaatgaacacgtggtcctcaggccacgccatgcgagagggaaacatccagggggaggtggtggttatgcgctgctcctctttcagcttgatgctggacatgatggggatgccctggttgtcacctgtggatatggagcaaggtgggacagggagccaggcctggctacccctggcccacaacctgctgagtgtaggctcagccagatgctcaatcttgtccctgcccaatctagacacagactctaagccacaggcttgagcaggcctgatattcaatgatgctcagtgtcagcttactcaatgagaagccctgataagacctctgttgggtggagctgtagggcttcaaaaggatggcagggacaggcaccatggctcacccctgtaatcccggcactttgggaggctgaggcaggaggatcacttgaggccaggagtccgtgaccagactgggcaatgcagtgagaccctgtctctac

SEQ ID NO: 193618 - DNA, 536 bp, Homo sapiens
tgttttttttttttttttttaaagagatggagtcctgatctgtcgcccaggctggagttcagtggcacaatattggcccactgcaacccttgaaccttcccggttcaagtgattctcctgcctaggtcttctgagtagctgggattacaggtgcccaccaccacgcccagctaatttttgtggttttagtagagacggagttttgccatgttggccaagctagtctcaaactcctgacctcaagtgatcggccggcctcagcctcccaaagtgctgggattacaggcttgagccactgcgcctggcccagttttcccatgtcttgaggcaccactacccatgcacctcagaatcctcccttgcctttatccctttgatacagcacatcccaaagtgaatccccacatggtccctggttgctcagactcagtgaaaaaaaaatgaatggtcaagtgagttttggaaaaccccaaacgcttgaaaaattcttggcacacataaacatattcaaggctctgagaagttctgcagcacaa

SEQ ID NO: 193619 - DNA, 551 bp, Homo sapiens
accattcagctgcacccagatgccccaagagcaatgagcccacacgcagagctggaggacctgaaaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaaggggg

SEQ ID NO: 193620 - DNA, 672 bp, Mus musculus
tgtgacacccttcctcacgcttagacagcaaagttgcctcggaagagaagagaagcctgcatgggaatggccagcacatcctaaatgctccagtggcccgtggttcgtcccttcgtctcattgactgccacagacaggaagtaggctcagggacttggcacctacccaacagcaggacgtcctttctggccatactcctgagggtaacaaaatcacatggaagcccaaagcaagccaggctcaggctcctctgccctctgctacttaacaatgtccgtccttccccagcccccctgcagatgcttctgtatgggaaagcccctctgcatctaatgacactctgctttcaaagacgggacagtccctggtctctggagagtgaccattcgtggccttctcagttgacacttctccgctgaggcatcccttagccctgaaccagaaatgaaagagccggctcagagtgaaaaggaagaatagccatcaatctgctcctgtgtgcaaggagcacagacctggtctcagactctgcccgtctcccccgcttccctgccctctgagtgactcacggtgcaggctgagggagatgttgatggtatgctcatccacaaagcccttcaggccaggcatccgggcaacttgagctgtgtctgggcacactgtcccaacgtg

SEQ ID NO: 193621 - DNA, 616 bp, Mus musculus
gacttttatctgcactgtttcaacagcaggtagccagccgtctttttactgcctgcctctggctgaagctcggcccacactatcaggactcagccctgtagggatgactctgccacacagctacagcaccagctggcacaaatggctttctctccaacttcctcaggcttccctgagtcactgcccagccctaggactggcaacaccctggccctgctcacccatccacccttggcaagagggaaagaggaagaagcctgcagagagctggtgccctgcttccagatgctgctccattctcaggccaagcctcaagatggggggaacctgagtgggagcctctctcctggcttgcgttccctcccacttctgggaaagcagggcagtgacagtccctgttctcatgtgtctgcccttggctgggctcccctcacctccccaaagaccaggcagggtcccattcagcagacctgactgtaaggaattggcaagaaatgacgtccctagccagcctggcctcccctttggtatttttgcagctggagattattagtctcaagcaaaactcctttgttatccaagcccactccaccacattattttcctctctcctaaa

SEQ ID NO: 193622 - DNA, 471 bp, Mus musculus
gacagggtcttattctgcagctcgggttgacctggaattctccaggcagaccattctggccttacgttcactgacatccacctgcctctgcctcctgagtgctgctgttaaggagtagttccagcctatagtgttctgaaatactgttattttactgtaatgatagccaaagctaaaatgagttaagaatagttcctttcttactcgctgtctcgttcctcattcacttgccccatcttcgtgccctcagaactaccccacccccaatcctcctttagccccagagccttctctgaaccctaccccttgcttcctgtcagcatctcagggccccctctttgcttccttaatctctactggaaacacagagaactcccctgccctctgccattcttctgctggagctaccttcccacccttgtgcaagccaggcccctcatacccaagcaggtgacaccatctgtgtccaac

SEQ ID NO: 193623 - DNA, 707 bp, Homo sapiens
gagctgcgctcaccgctgttgcctgattttggtctaagtgaaggcttgcggttcagattccaacaacttccctttgtaaaggaaatggacaagaaactcccccctggatatgccttgaagccagctacagcgtgaggtggtgcagctagaaagtgctagaaacacacaccagctctcagaagtctggaggaaaacatcaggggtgtagtctccttgacaacagaggaaacatcacattctcagccatcccgggagagagaaactaaagtgatgaacaaacaaggccttgcctaagacttccttaacattttctcttaaggaagaggttgattgaggaaaaatcgccgcttggacagctgaaccgaagccattcacagcctctgaagaagcgaggccaccccagggggtcggtcccgggggatagctgccccaccgtggctgaagatctcggctgcagaccaaggaggggcggggagattctgaggcaacgtttcaacctcgtaaggaaccgaggccttgagggtggccgggggcccctctgtgaacttgatcggggctggtggggcgagggcgccccccaggacaaggtggggacggaggtgtcgccacagagcacagcggaaaccggggacttcgccaggagggcccaggataacggagggcgactcgtgtatgtcgcggaggcggctccggggacccgggacttg

SEQ ID NO: 193624 - DNA, 741 bp, Homo sapiens
ggggctccctctcaacctattctggcgcctggagcaagccttacctgcagtccccgccgcggcgaggagcaaggcgacggtccagcgcaatttccagccccagggccccatgctcgcagcctctgccaggcagtgtcccgacccggatcacgacctgctgtgtcctagctggaaaccctggcttcccgcgattgcactcggggcccacgtcatttacagcatttcaatgtgaggtttctagcagggggaggagtttgcagtggggtgattttcaaatgtcttcacctcactgcaagaggaggagtttcgaacggccgatgtgacatcggctttttaacccgtgaagctctgattcccactccagtccttcgaaagtgtcgccagggcaggcgacttgatttgttgtatttgggtctccggtgaagagctgacgccccctcaaaattggaaacgcatcttctgaaagatcctcctgaaatttctcgatgtttaactgttaacattttgctgttgttgtccacagaaggataacaacagcctttcaagatcctccaatagcctaatgccattgtcctctctgcctcaaaaggaaaacactaaaaatgttgggaacttccgccactttctatatttgccttttcctttctaggaattgtgtatagatttttagcttcctttcgttgtatattgtttttacattgttattccaaatcacctaatagacactgatcaatcaggaat

SEQ ID NO: 193625 - DNA, 346 bp, Homo sapiens
cccacgtatattttttgttgttttttgttttttttctgtaaaatgtcccggttcttccataacttataaacatgatttataccgaggagatgggaaagtggacggggcagggtggactgaccggggatggggaagctcctctcgctgccccctcggggcgggcccaggccctttggaggatggggacgccaggacactcctccctgaggttgctggccgcctctgccctggtgctgtgaagtcagagccccgatactccccgtccacctgccagttcacaaacttcgactgctgggtctggatggccatcttggacctgagaccggggcccagctggtgaatgacc

SEQ ID NO: 193626 - DNA, 867 bp, Homo sapiens
accatcttttttttttttcttttatgcgtgaaacttggtgaatctttattaaactagggtccaccccaggaggacggctggggcggggacagggtctcccgctgcaggctgcgcggaggcaggaggcacggggtggcgtggggtcgcatggctgcaggcttcggcgttcagtgattgtcgctgggcacaggggcggcgctggtgcccacggcagcctgcaccttctccaccagcccggcccactggcgctgcatgtcttccaccaggggctcgaaccagctcttgaggcgggcctggaaggcctcggcctgcaggcgtatctgctgggcctgctcctccagcttggcgcgcacctccgccacctgctccttcacctcgtccaggcggtcgcgggtccggctgcccatctcctccatccgcgcgcgcagccgctcgccccaggcctgggcccgctcctgtagcggctggccggccagggagcccacagtggcggcccgcacgcggccctgttccaccaggggccccaggcgctcgcggatggcgctgaggccgcgctcggcgccctcgcgggccccggcctggtacactgccaggcgcttctgcaggtcatcggcatcgcggaggagccgcttacgcagcttgcgcaggtgggaggcgaggcgcacccgcagctcctcggtgctctggccgagcatggcctgcacctcgccgcggtactgcaccaggcggccgcacacgtcctccatgtccgcgcccagccgggcctgcgccgcctgcagctccttggacagccgtgcccgcgtctcctccgccaccggggtcagttgttcctccagttccgatttgtaggccttcaactccttcatg

SEQ ID NO: 193627 - DNA, 563 bp, Homo sapiens
cagcttctcttgcagctcgtgcagcttctggcgcgcgccctcttggagctctgcgcgcagcggctccaccttctggcggtagagctccatctcctcctgccacttcttctggaagtcgtccagatccaaatggcaaaccttcttcatccaccaggacccaacccacaggctacttattgctggaaacctacgttgttccttggattgaagtaatctctccctcttctggtgcgcccacagcacttgcaccaacagtgggtacccaacagactagcgtgcctgccgaagaaggggtcctctgacaatcaggggacaatggggaattatgctctccagactttctacacacacaagtcacacaggaaggaaggtaaagagaaactagagaaaataatttttgaagaaaaacatttcaggaagtattgaaagtacacggtaactcagcctggggcaggggtggagggcagcagcactgtttgctgcagctatgctccttcctcagtgccctgcacacccgggacttgctcggtgagcatctctcgtgtcagtgacagctagtgtga

SEQ ID NO: 193628 - RNA, 27 nt, Artificial Sequence
  Antisense oligonucleotide
uuguaaaguaugagcuuggugucagca

SEQ ID NO: 193629 - RNA, 27 nt, Artificial Sequence
  Antisense oligonucleotide
aaucaauggcuguucucucucugggac

SEQ ID NO: 193630 - RNA, 27 nt, Artificial Sequence
  Antisense oligonucleotide
accuauaauuccagcacuuugagaggc

SEQ ID NO: 193631 - DNA, 20 bp, Artificial Sequence
  Antisense oligonucleotide
cccaccacttgcaactcaga

SEQ ID NO: 193632 - DNA, 21 bp, Artificial Sequence
  Antisense oligonucleotide
ttcgggaagtgctcggtttcg

SEQ ID NO: 193633 - DNA, 21 bp, Artificial Sequence
  Antisense oligonucleotide
cccagctcagatccatccctt

SEQ ID NO: 193634 - DNA, 20 bp, Artificial Sequence
  Antisense oligonucleotide
gcctcttctatgggtctgtc

SEQ ID NO: 193635 - DNA, 19 bp, Artificial Sequence
  Antisense oligonucleotide
gccatgccacccagagtta

SEQ ID NO: 193636 - DNA, 21 bp, Artificial Sequence
  Antisense oligonucleotide
gctgttctctctctgggactt

SEQ ID NO: 193637 - DNA, 19 bp, Artificial Sequence
  Antisense oligonucleotide
gttcccattcccttattag

SEQ ID NO: 193638 - DNA, 20 bp, Artificial Sequence
  Antisense oligonucleotide
cgaatcacttagccactttg

SEQ ID NO: 193639 - DNA, 20 bp, Artificial Sequence
  Antisense oligonucleotide
ctgggattacaggcgtgagc

SEQ ID NO: 193640 - DNA, 21 bp, Artificial Sequence
  Antisense oligonucleotide
catgtctcctgcctttcctgt

SEQ ID NO: 193641 - DNA, 21 bp, Artificial Sequence
  Antisense oligonucleotide
gctcacaatatcaggctgctt

SEQ ID NO: 193642 - DNA, 21 bp, Artificial Sequence
  Antisense oligonucleotide
tcaactttacccagacaagca

SEQ ID NO: 193643 - DNA, 21 bp, Artificial Sequence
  Antisense oligonucleotide
ggacagggtagcaacgccatt

SEQ ID NO: 193644 - DNA, 19 bp, Artificial Sequence
  Antisense oligonucleotide
ccacctcagttgcacggaa

SEQ ID NO: 193645 - DNA, 20 bp, Artificial Sequence
  Antisense oligonucleotide
ttgggcatagagtttggttc

SEQ ID NO: 193646 - RNA, 27 nt, Artificial Sequence
  Antisense oligonucleotide
guggucagucacagccacaccagacuu

SEQ ID NO: 193647 - RNA, 27 nt, Artificial Sequence
  Antisense oligonucleotide
gucccuucucccaccacacugugacuc

SEQ ID NO: 193648 - RNA, 27 nt, Artificial Sequence
  Antisense oligonucleotide
cagcacugacacagcuaccaccuacuc

SEQ ID NO: 193649 - RNA, 27 nt, Artificial Sequence
  Antisense oligonucleotide
ugugcuucacugaggauggaucugcca

SEQ ID NO: 193650 - RNA, 27 nt, Artificial Sequence
  Antisense oligonucleotide
agagaaacgcucaucagacaccaccaa

SEQ ID NO: 193651 - RNA, 27 nt, Artificial Sequence
  Antisense oligonucleotide
cuuaggaagcacaagaggcugagccuu

SEQ ID NO: 193652 - RNA, 27 nt, Artificial Sequence
  Antisense oligonucleotide
ccuggcucccugucccaccuugcucca

SEQ ID NO: 193653 - RNA, 27 nt, Artificial Sequence
  Antisense oligonucleotide
guucauuuccacacccagcuucaacua

SEQ ID NO: 193654 - DNA, 19 bp, Artificial sequence
  Antisense oligonucleotide
agacctatctgttcccacc

SEQ ID NO: 193655 - DNA, 20 bp, Artificial Sequence
  Antisense oligonucleotide
gtcagtcacagccacaccag

SEQ ID NO: 193656 - DNA, 19 bp, Artificial Sequence
  Antisense oligonucleotide
cctatctgttcccaccttg

SEQ ID NO: 193657 - DNA, 21 bp, Artificial Sequence
  Antisense oligonucleotide
gtcacagccacaccagactct

SEQ ID NO: 193658 - DNA, 21 bp, Artificial Sequence
  Antisense oligonucleotide
tcccttctcccaccacactgt

SEQ ID NO: 193659 - DNA, 20 bp, Artificial Sequence
  Antisense oligonucleotide
ctcctcaatgtgctcttccc

SEQ ID NO: 193660 - DNA, 19 bp, Artificial Sequence
  Antisense oligonucleotide
cccactcccacaccagata

SEQ ID NO: 193661 - DNA, 20 bp, Artificial Sequence
  Antisense oligonucleotide
aacagcctcttcccagcacc

SEQ ID NO: 193662 - DNA, 20 bp, Artificial Sequence
  Antisense oligonucleotide
caccatctactcctgagccc

SEQ ID NO: 193663 - DNA, 20 bp, Artificial Sequence
  Antisense oligonucleotide
tcattgtcacgcgctcccac

SEQ ID NO: 193664 - DNA, 21 bp, Artificial Sequence
  Antisense oligonucleotide
tcccagctactcagaagacct

SEQ ID NO: 193665 - DNA, 20 bp, Artificial Sequence
  Antisense oligonucleotide
tgggcgacagatcaggactc

SEQ ID NO: 193666 - DNA, 21 bp, Artificial Sequence
  Antisense oligonucleotide
ctgaggtgcatgggtagtggt

SEQ ID NO: 193667 - DNA, 21 bp, Artificial Sequence
  Antisense oligonucleotide
gccgatcacttgaggtcagga

SEQ ID NO: 193668 - DNA, 20 bp, Artificial Sequence
  Antisense oligonucleotide
attagctgggcgtggtggtg

SEQ ID NO: 193669 - DNA, 20 bp, Artificial Sequence
  Antisense oligonucleotide
gctctgcgtgtgggctcatt

SEQ ID NO: 193670 - DNA, 21 bp, Artificial Sequence
  Antisense oligonucleotide
gtccctctgatatatgctctc

SEQ ID NO: 193671 - DNA, 21 bp, Artificial Sequence
  Antisense oligonucleotide
cttgagttcttcctgcttcca

SEQ ID NO: 193672 - DNA, 20 bp, Artificial Sequence
  Antisense oligonucleotide
tctccagccagtcacccaga

SEQ ID NO: 193673 - DNA, 21 bp, Artificial Sequence
  Antisense oligonucleotide
ccatcaacatctccctcagcc

SEQ ID NO: 193674 - DNA, 20 bp, Artificial Sequence
  Antisense oligonucleotide
cttcttcctctttccctctt

SEQ ID NO: 193675 - DNA, 20 bp, Artificial Sequence
  Antisense oligonucleotide
acagcagcactcaggaggca

SEQ ID NO: 193676 - DNA, 20 bp, Artificial Sequence
  Antisense oligonucleotide
gggtagttctgagggcacga

SEQ ID NO: 193677 - DNA, 19 bp, Artificial Sequence
  Antisense oligonucleotide
aggcaggtggatgtcagtg

SEQ ID NO: 193678 - DNA, 20 bp, Artificial Sequence
  Antisense oligonucleotide
gggtagggttcagagaaggc

SEQ ID NO: 193679 - DNA, 20 bp, Artificial Sequence
  Antisense oligonucleotide
actcctcctcttgcagtgag

SEQ ID NO: 193680 - DNA, 20 bp, Artificial Sequence
  Antisense oligonucleotide
gctgttgttatccttctgtg

SEQ ID NO: 193681 - DNA, 20 bp, Artificial Sequence
  Antisense oligonucleotide
atcgcgggaagccagggttt

SEQ ID NO: 193682 - DNA, 21 bp, Artificial Sequence
  Antisense oligonucleotide
gccagaataggttgagaggga

SEQ ID NO: 193683 - DNA, 21 bp, Artificial Sequence
  Antisense oligonucleotide
gccgttcgaaactcctcctct

SEQ ID NO: 193684 - DNA, 20 bp, Artificial Sequence
  Antisense oligonucleotide
ggtttccgctgtgctctgtg

SEQ ID NO: 193685 - DNA, 20 bp, Artificial Sequence
  Antisense oligonucleotide
acgttgcctcagaatctccc

SEQ ID NO: 193686 - DNA, 21 bp, Artificial Sequence
  Antisense oligonucleotide
ttcctcaatcaacctcttcct

SEQ ID NO: 193687 - DNA, 20 bp, Artificial Sequence
  Antisense oligonucleotide
gtgatgtttcctctgttgtc

SEQ ID NO: 193688 - DNA, 20 bp, Artificial Sequence
  Antisense oligonucleotide
cactttctagctgcaccacc

SEQ ID NO: 193689 - DNA, 21 bp, Artificial Sequence
  Antisense oligonucleotide
ccgtccactttcccatctcct

SEQ ID NO: 193690 - DNA, 20 bp, Artificial Sequence
  Antisense oligonucleotide
cccgtccactttcccatctc

SEQ ID NO: 193691 - DNA, 20 bp, Artificial Sequence
  Antisense oligonucleotide
cttcacagcaccagggcaga

SEQ ID NO: 193692 - DNA, 21 bp, Artificial Sequence
  Antisense oligonucleotide
cccagcagtcgaagtttgtga

SEQ ID NO: 193693 - DNA, 20 bp, Artificial Sequence
  Antisense oligonucleotide
ccggtctcaggtccaagatg

SEQ ID NO: 193694 - DNA, 20 bp, Artificial Sequence
  Antisense oligonucleotide
tggtggagaaggtgcaggct

SEQ ID NO: 193695 - DNA, 21 bp, Artificial Sequence
  Antisense oligonucleotide
gattcaccaagtttcacgcat

SEQ ID NO: 193696 - DNA, 20 bp, Artificial Sequence
  Antisense oligonucleotide
gacgaggtgaaggagcaggt

SEQ ID NO: 193697 - DNA, 21 bp, Artificial Sequence
  Antisense oligonucleotide
tcggaactggaggaacaactg

SEQ ID NO: 193698 - DNA, 13 bp, Artificial Sequence
  Antisense oligonucleotide
tggagctcagttt

SEQ ID NO: 193699 - DNA, 14 bp, Artificial Sequence
  Antisense oligonucleotide
tttctcgtgcagct

SEQ ID NO: 193700 - DNA, 14 bp, Artificial Sequence
  Antisense oligonucleotide
ttctggcgcgtgcc

SEQ ID NO: 193701 - DNA, 14 bp, Artificial Sequence
  Antisense oligonucleotide
ccctcgtggagctc

SEQ ID NO: 193702 - DNA, 14 bp, Artificial Sequence
  Antisense oligonucleotide
gcccgcgcgcagcg

SEQ ID NO: 193703 - DNA, 14 bp, Artificial Sequence
  Antisense oligonucleotide
cggctccaccttct

SEQ ID NO: 193704 - DNA, 14 bp, Artificial Sequence
  Antisense oligonucleotide
ctggcggtagagct

SEQ ID NO: 193705 - DNA, 14 bp, Artificial Sequence
  Antisense oligonucleotide
gctcgtgcagcttc

SEQ ID NO: 193706 - DNA, 14 bp, Artificial Sequence
  Antisense oligonucleotide
cagcttctggcgcg

SEQ ID NO: 193707 - DNA, 14 bp, Artificial sequence
  Antisense oligonucleotide
gcgcgcagcggctc

SEQ ID NO: 193708 - DNA, 14 bp, Artificial Sequence
  Antisense oligonucleotide
tccaccttctggcg

SEQ ID NO: 193709 - DNA, 14 bp, Artificial Sequence
  Antisense oligonucleotide
cggtgtagagctcc

SEQ ID NO: 193710 - DNA, 14 bp, Artificial Sequence
  Antisense oligonucleotide
ccatctcctcctgc

SEQ ID NO: 193711 - DNA, 19 bp, Artificial Sequence
  Antisense oligonucleotide
gaagtcgtccagatccaaa

SEQ ID NO: 193712 - DNA, 19 bp, Artificial Sequence
  Antisense oligonucleotide
aagtcgtccagatccaaat

SEQ ID NO: 193713 - DNA, 19 bp, Artificial Sequence
  Antisense oligonucleotide
agtcgtccagatccaaatg

SEQ ID NO: 193714 - DNA, 19 bp, Artificial Sequence
  Antisense oligonucleotide
gtcgtccagatccaaatgg

SEQ ID NO: 193715 - DNA, 19 bp, Artificial Sequence
  Antisense oligonucleotide
tcgtccagatccaaatggc

SEQ ID NO: 193716 - DNA, 19 bp, Artificial Sequence
  Antisense oligonucleotide
cgtccagatccaaatggca

SEQ ID NO: 193717 - DNA, 19 bp, Artificial Sequence
  Antisense oligonucleotide
gtccagatccaaatggcaa

SEQ ID NO: 193718 - DNA, 19 bp, Artificial Sequence
  Antisense oligonucleotide
tccagatccaaatggcaaa

SEQ ID NO: 193719 - DNA, 12 bp, Artificial Sequence
  Antisense oligonucleotide
cagatccaaatg

SEQ ID NO: 193720 - DNA, 16 bp, Artificial Sequence
  Antisense oligonucleotide
agatccaaatggcaaa

SEQ ID NO: 193721 - DNA, 12 bp, Artificial Sequence
  Antisense oligonucleotide
agatccaaatgg

SEQ ID NO: 193722 - DNA, 12 bp, Artificial Sequence
  Antisense oligonucleotide
gatccaaatggc

SEQ ID NO: 193723 - DNA, 12 bp, Artificial Sequence
  Antisense oligonucleotide
atccaaatggca

SEQ ID NO: 193724 - DNA, 12 bp, Artificial Sequence
  Antisense oligonucleotide
tccaaatggcaa

SEQ ID NO: 193725 - DNA, 12 bp, Artificial Sequence
  Antisense oligonucleotide
ccaaatggcaaa

SEQ ID NO: 193726 - DNA, 19 bp, Artificial Sequence
  Antisense oligonucleotide
ccaaatggcaaaccttctt

SEQ ID NO: 193727 - DNA, 19 bp, Artificial Sequence
  Antisense oligonucleotide
atggcaaatcttcttcatc

SEQ ID NO: 193728 - DNA, 19 bp, Artificial Sequence
  Antisense oligonucleotide
aaatggcaaaccttcttca

SEQ ID NO: 193729 - DNA, 19 bp, Artificial Sequence
  Antisense oligonucleotide
aaatggcaaatcttcttca

SEQ ID NO: 193730 - DNA, 19 bp, Artificial Sequence
  Antisense oligonucleotide
atggcaaaccttcttcatc

SEQ ID NO: 193731 - DNA, 19 bp, Artificial Sequence
  Antisense oligonucleotide
ccaaatggcaaatcttctt

SEQ ID NO: 193732 - DNA, 15 bp, Artificial Sequence
  Antisense oligonucleotide
atggcaaaccttctt

SEQ ID NO: 193733 - DNA, 15 bp, Artificial Sequence
  Antisense oligonucleotide
atggcaaatcttctt

SEQ ID NO: 193734 - DNA, 11 bp, Artificial Sequence
  Antisense oligonucleotide
cttcttcatcc

SEQ ID NO: 193735 - DNA, 17 bp, Artificial Sequence
  Antisense oligonucleotide
ccaggacccaacccaca

SEQ ID NO: 193736 - DNA, 14 bp, Artificial Sequence
  Antisense oligonucleotide
gctacttattgctg

SEQ ID NO: 193737 - DNA, 14 bp, Artificial Sequence
  Antisense oligonucleotide
tgctggaaacctac

SEQ ID NO: 193738 - DNA, 14 bp, Artificial Sequence
  Antisense oligonucleotide
ttccttggattgaa

SEQ ID NO: 193739 - DNA, 16 bp, Artificial Sequence
  Antisense oligonucleotide
gcccacagcacttgca

SEQ ID NO: 193740 - DNA, 16 bp, Artificial Sequence
  Antisense oligonucleotide
caccaacagtgggtac

SEQ ID NO: 193741 - DNA, 12 bp, Artificial Sequence
  Antisense oligonucleotide
caacagactagc

SEQ ID NO: 193742 - DNA, 14 bp, Artificial Sequence
  Antisense oligonucleotide
gaagaaggggtcct

SEQ ID NO: 193743 - DNA, 14 bp, Artificial Sequence
  Antisense oligonucleotide
gaattatgctctcc

SEQ ID NO: 193744 - DNA, 14 bp, Artificial Sequence
  Antisense oligonucleotide
ctccagactttcta

SEQ ID NO: 193745 - DNA, 16 bp, Artificial Sequence
  Antisense oligonucleotide
aagtcacacaggaagg

SEQ ID NO: 193746 - DNA, 14 bp, Artificial Sequence
  Antisense oligonucleotide
gaaactagagaaaa

SEQ ID NO: 193747 - DNA, 14 bp, Artificial Sequence
  Antisense oligonucleotide
aataatttttgaag

SEQ ID NO: 193748 - DNA, 14 bp, Artificial Sequence
  Antisense oligonucleotide
gaagtattgaaagt

SEQ ID NO: 193749 - DNA, 14 bp, Artificial Sequence
  Antisense oligonucleotide
tgaaagtacacggt

SEQ ID NO: 193750 - DNA, 14 bp, Artificial Sequence
  Antisense oligonucleotide
ctggggcaggggtg

SEQ ID NO: 193751 - DNA, 14 bp, Artificial Sequence
  Antisense oligonucleotide
ggggtggagggcag

SEQ ID NO: 193752 - DNA, 14 bp, Artificial Sequence
  Antisense oligonucleotide
tgctccttcctcag

SEQ ID NO: 193753 - DNA, 15 bp, Artificial Sequence
  Antisense oligonucleotide
acccgggacttgctc

SEQ ID NO: 193754 - DNA, 14 bp, Artificial Sequence
  Antisense oligonucleotide
tgtcagtgacagct

SEQ ID NO: 193755 - DNA, 19 bp, Artificial Sequence
  Antisense oligonucleotide
tgtcagtgacagctagtgt

SEQ ID NO: 193756 - DNA, 19 bp, Artificial Sequence
  Antisense oligonucleotide
gtcagtgacagctagtgtg

SEQ ID NO: 193757 - DNA, 19 bp, Artificial Sequence
  Antisense oligonucleotide
tcagtgacagctagtgtga

SEQ ID NO: 193758 - DNA, 19 bp, Artificial Sequence
  Antisense oligonucleotide
agtgacagctagtgtgagt

SEQ ID NO: 193759 - DNA, 15 bp, Artificial Sequence
  Antisense oligonucleotide
tgacagctagtgtga

SEQ ID NO: 193760 - DNA, 19 bp, Artificial Sequence
  Antisense oligonucleotide
tgacagctagtgtgagtac

SEQ ID NO: 193761 - DNA, 19 bp, Artificial Sequence
  Antisense oligonucleotide
gacagctagtgtgagtact

SEQ ID NO: 193762 - DNA, 19 bp, Artificial Sequence
  Antisense oligonucleotide
cagctagtgtgagtactct

SEQ ID NO: 193763 - DNA, 19 bp, Artificial Sequence
  Antisense oligonucleotide
agctagtgtgagtactctt

SEQ ID NO: 193764 - DNA, 19 bp, Artificial Sequence
  Antisense oligonucleotide
gctagtgtgagtactctta

SEQ ID NO: 193765 - DNA, 19 bp, Artificial Sequence
  Antisense oligonucleotide
ctagtgtgagtactcttat

SEQ ID NO: 193766 - DNA, 14 bp, Artificial Sequence
  Antisense oligonucleotide
ctagtgtgagtact

SEQ ID NO: 193767 - DNA, 19 bp, Artificial Sequence
  Antisense oligonucleotide
tagtgtgagtactcttatg

SEQ ID NO: 193768 - DNA, 19 bp, Artificial Sequence
  Antisense oligonucleotide
agtgtgagtactcttatgt

SEQ ID NO: 193769 - DNA, 19 bp, Artificial Sequence
  Antisense oligonucleotide
gtgtgagtactcttatgtt

SEQ ID NO: 193770 - DNA, 19 bp, Artificial Sequence
  Antisense oligonucleotide
tgtgagtactcttatgttc

SEQ ID NO: 193771 - DNA, 19 bp, Artificial Sequence
  Antisense oligonucleotide
gtgagtactcttatgttca

SEQ ID NO: 193772 - DNA, 19 bp, Artificial Sequence
  Antisense oligonucleotide
tgagtactcttatgttcag

SEQ ID NO: 193773 - DNA, 14 bp, Artificial Sequence
  Antisense oligonucleotide
actcttatgttcag

SEQ ID NO: 193774 - DNA, 14 bp, Artificial Sequence
  Antisense oligonucleotide
tacctcttgacttt

SEQ ID NO: 193775 - DNA, 14 bp, Artificial Sequence
  Antisense oligonucleotide
gactttggggacaa

SEQ ID NO: 193776 - DNA, 13 bp, Artificial Sequence
  Antisense oligonucleotide
aaactgagctcca

SEQ ID NO: 193777 - DNA, 14 bp, Artificial Sequence
  Antisense oligonucleotide
agctgcacgagaaa

SEQ ID NO: 193778 - DNA, 14 bp, Artificial Sequence
  Antisense oligonucleotide
ggcacgcgccagaa

SEQ ID NO: 193779 - DNA, 14 bp, Artificial Sequence
  Antisense oligonucleotide
gagctccacgaggg

SEQ ID NO: 193780 - DNA, 14 bp, Artificial Sequence
  Antisense oligonucleotide
cgctgcgcgcgggc

SEQ ID NO: 193781 - DNA, 14 bp, Artificial Sequence
  Antisense oligonucleotide
agaaggtggagccg

SEQ ID NO: 193782 - DNA, 14 bp, Artificial Sequence
  Antisense oligonucleotide
agctctaccgccag

SEQ ID NO: 193783 - DNA, 14 bp, Artificial Sequence
  Antisense oligonucleotide
gaagctgcacgagc

SEQ ID NO: 193784 - DNA, 14 bp, Artificial Sequence
  Antisense oligonucleotide
cgcgccagaagctg

SEQ ID NO: 193785 - DNA, 14 bp, Artificial Sequence
  Antisense oligonucleotide
gagccgctgcgcgc

SEQ ID NO: 193786 - DNA, 14 bp, Artificial Sequence
  Antisense oligonucleotide
cgccagaaggtgga

SEQ ID NO: 193787 - DNA, 14 bp, Artificial Sequence
  Antisense oligonucleotide
ggagctctacaccg

SEQ ID NO: 193788 - DNA, 14 bp, Artificial Sequence
  Antisense oligonucleotide
gcaggaggagatgg

SEQ ID NO: 193789 - DNA, 19 bp, Artificial Sequence
  Antisense oligonucleotide
tttggatctggacgacttc

SEQ ID NO: 193790 - DNA, 19 bp, Artificial Sequence
  Antisense oligonucleotide
atttggatctggacgactt

SEQ ID NO: 193791 - DNA, 19 bp, Artificial Sequence
  Antisense oligonucleotide
catttggatctggacgact

SEQ ID NO: 193792 - DNA, 19 bp, Artificial Sequence
  Antisense oligonucleotide
ccatttggatctggacgac

SEQ ID NO: 193793 - DNA, 19 bp, Artificial sequence
  Antisense oligonucleotide
gccatttggatctggacga

SEQ ID NO: 193794 - DNA, 19 bp, Artificial sequence
  Antisense oligonucleotide
tgccatttggatctggacg

SEQ ID NO: 193795 - DNA, 19 bp, Artificial Sequence
  Antisense oligonucleotide
ttgccatttggatctggac

SEQ ID NO: 193796 - DNA, 19 bp, Artificial Sequence
  Antisense oligonucleotide
tttgccatttggatctgga

SEQ ID NO: 193797 - DNA, 12 bp, Artificial Sequence
  Antisense oligonucleotide
catttggatctg

SEQ ID NO: 193798 - DNA, 16 bp, Artificial Sequence
  Antisense oligonucleotide
tttgccatttggatct

SEQ ID NO: 193799 - DNA, 12 bp, Artificial Sequence
  Antisense oligonucleotide
ccatttggatct

SEQ ID NO: 193800 - DNA, 12 bp, Artificial Sequence
  Antisense oligonucleotide
gccatttggatc

SEQ ID NO: 193801 - DNA, 12 bp, Artificial Sequence
  Antisense oligonucleotide
tgccatttggat

SEQ ID NO: 193802 - DNA, 12 bp, Artificial Sequence
  Antisense oligonucleotide
tgccatttggat

SEQ ID NO: 193803 - DNA, 12 bp, Artificial Sequence
  Antisense oligonucleotide
tttgccatttgg

SEQ ID NO: 193804 - DNA, 19 bp, Artificial Sequence
  Antisense oligonucleotide
aagaaggtttgccatttgg

SEQ ID NO: 193805 - DNA, 19 bp, Artificial Sequence
  Antisense oligonucleotide
gatgaagaagatttgccat

SEQ ID NO: 193806 - DNA, 19 bp, Artificial Sequence
  Antisense oligonucleotide
tgaagaaggtttgccattt

SEQ ID NO: 193807 - DNA, 19 bp, Artificial Sequence
  Antisense oligonucleotide
tgaagaagatttgccattt

SEQ ID NO: 193808 - DNA, 19 bp, Artificial Sequence
  Antisense oligonucleotide
gatgaagaaggtttgccat

SEQ ID NO: 193809 - DNA, 19 bp, Artificial Sequence
  Antisense oligonucleotide
aagaagatttgccatttgg

SEQ ID NO: 193810 - DNA, 15 bp, Artificial Sequence
  Antisense oligonucleotide
aagaaggtttgccat

SEQ ID NO: 193811 - DNA, 15 bp, Artificial Sequence
  Antisense oligonucleotide
aagaagatttgccat

SEQ ID NO: 193812 - DNA, 11 bp, Artificial Sequence
  Antisense oligonucleotide
ggatgaagaag

SEQ ID NO: 193813 - DNA, 17 bp, Artificial Sequence
  Antisense oligonucleotide
tgtgggttgggtcctgg

SEQ ID NO: 193814 - DNA, 14 bp, Artificial Sequence
  Antisense oligonucleotide
cagcaataagtagc

SEQ ID NO: 193815 - DNA, 14 bp, Artificial Sequence
  Antisense oligonucleotide
gtaggtttccagca

SEQ ID NO: 193816 - DNA, 14 bp, Artificial Sequence
  Antisense oligonucleotide
ttcaatccaaggaa

SEQ ID NO: 193817 - DNA, 16 bp, Artificial Sequence
  Antisense oligonucleotide
tgcaagtgctgtgggc

SEQ ID NO: 193818 - DNA, 16 bp, Artificial Sequence
  Antisense oligonucleotide
gtacccactgttggtg

SEQ ID NO: 193819 - DNA, 12 bp, Artificial Sequence
  Antisense oligonucleotide
gctagtctgttg

SEQ ID NO: 193820 - DNA, 14 bp, Artificial Sequence
  Antisense oligonucleotide
aggaccccttcttc

SEQ ID NO: 193821 - DNA, 14 bp, Artificial Sequence
  Antisense oligonucleotide
ggagagcataattc

SEQ ID NO: 193822 - DNA, 14 bp, Artificial Sequence
  Antisense oligonucleotide
tagaaagtctggag

SEQ ID NO: 193823 - DNA, 16 bp, Artificial Sequence
  Antisense oligonucleotide
ccttcctgtgtgactt

SEQ ID NO: 193824 - DNA, 14 bp, Artificial Sequence
  Antisense oligonucleotide
ttttctctagtttc

SEQ ID NO: 193825 - DNA, 14 bp, Artificial Sequence
  Antisense oligonucleotide
cttcaaaaattatt

SEQ ID NO: 193826 - DNA, 14 bp, Artificial Sequence
  Antisense oligonucleotide
actttcaatacttc

SEQ ID NO: 193827 - DNA, 14 bp, Artificial Sequence
  Antisense oligonucleotide
accgtgtactttca

SEQ ID NO: 193828 - DNA, 14 bp, Artificial Sequence
  Antisense oligonucleotide
cacccctgccccag

SEQ ID NO: 193829 - DNA, 14 bp, Artificial Sequence
  Antisense oligonucleotide
ctgccctccacccc

SEQ ID NO: 193830 - DNA, 14 bp, Artificial Sequence
  Antisense oligonucleotide
ctgaggaaggagca

SEQ ID NO: 193831 - DNA, 15 bp, Artificial Sequence
  Antisense oligonucleotide
gagcaagtcccgggt

SEQ ID NO: 193832 - DNA, 14 bp, Artificial Sequence
  Antisense oligonucleotide
agctgtcactgaca

SEQ ID NO: 193833 - DNA, 19 bp, Artificial Sequence
  Antisense oligonucleotide
acactagctgtcactgaca

SEQ ID NO: 193834 - DNA, 19 bp, Artificial Sequence
  Antisense oligonucleotide
cacactagctgtcactgac

SEQ ID NO: 193835 - DNA, 19 bp, Artificial Sequence
  Antisense oligonucleotide
tcacactagctgtcactga

SEQ ID NO: 193836 - DNA, 19 bp, Artificial Sequence
  Antisense oligonucleotide
actcacactagctgtcact

SEQ ID NO: 193837 - DNA, 15 bp, Artificial Sequence
  Antisense oligonucleotide
tcacactagctgtca

SEQ ID NO: 193838 - DNA, 19 bp, Artificial Sequence
  Antisense oligonucleotide
gtactcacactagctgtca

SEQ ID NO: 193839 - DNA, 19 bp, Artificial Sequence
  Antisense oligonucleotide
agtactcacactagctgtc

SEQ ID NO: 193840 - DNA, 19 bp, Artificial Sequence
  Antisense oligonucleotide
agagtactcacactagctg

SEQ ID NO: 193841 - DNA, 19 bp, Artificial Sequence
  Antisense oligonucleotide
aagagtactcacactagct

SEQ ID NO: 193842 - DNA, 19 bp, Artificial sequence
  Antisense oligonucleotide
taagagtactcacactagc

SEQ ID NO: 193843 - DNA, 19 bp, Artificial Sequence
  Antisense oligonucleotide
ataagagtactcacactag

SEQ ID NO: 193844 - DNA, 14 bp, Artificial Sequence
  Antisense oligonucleotide
agtactcacactag

SEQ ID NO: 193845 - DNA, 19 bp, Artificial Sequence
  Antisense oligonucleotide
cataagagtactcacacta

SEQ ID NO: 193846 - DNA, 19 bp, Artificial Seqiuence
  Antisense oligonucleotide
acataagagtactcacact

SEQ ID NO: 193847 - DNA, 19 bp, Artificial Sequence
  Antisense oligonucleotide
aacataagagtactcacac

SEQ ID NO: 193848 - DNA, 19 bp, Artificial Sequence
  Antisense oligonucleotide
gaacataagagtactcaca

SEQ ID NO: 193849 - DNA, 19 bp, Artificial Sequence
  Antisense oligonucleotide
tgaacataagagtactcac

SEQ ID NO: 193850 - DNA, 19 bp, Artificial Sequence
  Antisense oligonucleotide
ctgaacataagagtactca

SEQ ID NO: 193851 - DNA, 14 bp, Artificial Sequence
  Antisense oligonucleotide
ctgaacataagagt

SEQ ID NO: 193852 - DNA, 14 bp, Artificial Sequence
  Antisense oligonucleotide
aaagtcaagaggta

SEQ ID NO: 193853 - DNA, 14 bp, Artificial Sequence
  Antisense oligonucleotide
ttgtccccaaagtc

SEQ ID NO: 193854 - DNA, 15 bp, Artificial Sequence
  Antisense oligonucleotide
aagaaggtttgccat

SEQ ID NO: 193855 - DNA, 15 bp, Artificial Sequence
  Antisense oligonucleotide
tcacactagctgtca

SEQ ID NO: 193856 - DNA, 15 bp, Artificial Sequence
  Antisense oligonucleotide
aagaaggtttgccat

SEQ ID NO: 193857 - DNA, 15 bp, Artificial Sequence
  Antisense oligonucleotide
tcacactagctgtca

SEQ ID NO: 193858 - DNA, 21 bp, Artificial Sequence
  Antisense oligonucleotide
ctcctcctgccacttcttctg

SEQ ID NO: 193859 - DNA, 22 bp, Artificial Sequence
  Antisense oligonucleotide
ctggtggatgaagaaggtttgc

SEQ ID NO: 193860 - DNA, 19 bp, Artificial Sequence
  Antisense oligonucleotide
tttggatctggacgacttc

SEQ ID NO: 193861 - DNA, 15 bp, Artificial Sequence
  Antisense oligonucleotide
caataagtagcctgt

SEQ ID NO: 193862 - DNA, 15 bp, Artificial Sequence
  Antisense oligonucleotide
cacgctagtctgttg

SEQ ID NO: 193863 - DNA, 15 bp, Artificial Sequence
  Antisense oligonucleotide
cttccttcctgtgtg

SEQ ID NO: 193864 - DNA, 15 bp, Artificial Sequence
  Antisense oligonucleotide
caggctgagttaccg

SEQ ID NO: 193865 - DNA, 12 bp, Artificial Sequence
  Antisense oligonucleotide
gctagtctgttg

SEQ ID NO: 193866 - DNA, 12 bp, Artificial Sequence
  Antisense oligonucleotide
gtctgatggaga

SEQ ID NO: 193867 - DNA, 6 bp, Artificial Sequence
  Antisense oligonucleotide
gctagt

SEQ ID NO: 193868 - DNA, 19 bp, Artificial Sequence
  Antisense oligonucleotide
tgccatttggatctggacg

SEQ ID NO: 193869 - RNA, 25 nt, Artificial Sequence
  synthetic polynucleotide
cugacaccaagcucauacuuuacaa

SEQ ID NO: 193870 - DNA, 25 bp, Artificial Sequence
  synthetic polynucleotide
cccagagagagaacagccauugatt

SEQ ID NO: 193871 - DNA, 25 bp, Artificial Sequence
  synthetic polynucleotide
cucucaaagugcuggaauuauaggt

SEQ ID NO: 193872 - RNA, 25 nt, Artificial Sequence
  synthetic polynucleotide
gucugguguggcugugacugaccac

SEQ ID NO: 193873 - RNA, 25 nt, Artificial Sequence
  synthetic polynucleotide
gucacaguguggugggagaagggac

SEQ ID NO: 193874 - DNA, 25 bp, Artificial Sequence
  synthetic polynucleotide
guaggugguagcugugucagugctg

SEQ ID NO: 193875 - RNA, 25 nt, Artificial Sequence
  synthetic polynucleotide
gcagauccauccucagugaagcaca

SEQ ID NO: 193876 - DNA, 25 bp, Artificial Sequence
  synthetic polynucleotide
gguggugucugaugagcguuucuct

SEQ ID NO: 193877 - RNA, 48 nt, Artificial Sequence
  synthetic polynucleotide
rgrgrcrurcrargrcrcrurcrururgrurgrcrururcrcruraag

SEQ ID NO: 193878 - RNA, 25 nt, Artificial Sequence
  synthetic polynucleotide
gagcaaggugggacagggagccagg

SEQ ID NO: 193879 - RNA, 25 nt, Artificial Sequence
  synthetic polynucleotide
guugaagcuggguguggaaaugaac

SEQ ID NO: 193880 - DNA, 19 bp, Artificial Sequence
  Probe Sequence
tttggatctggacgacttc

SEQ ID NO: 193881 - DNA, 21 bp, Artificial Sequence
  Forward Primer
ctcctcctgccacttcttctg

SEQ ID NO: 193882 - DNA, 22 bp, Artificial Sequence
  Reverse Primer
ctggtggatgaagaaggtttgc

SEQ ID NO: 193883 - DNA, 12 bp, Artificial sequence
  Antisense oligonucleotide
gctagtctgttg

SEQ ID NO: 193884 - DNA, 12 bp, Artificial Sequence
  Antisense oligonucleotide
gtctgatggaga

SEQ ID NO: 193885 - DNA, 584 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcac

SEQ ID NO: 193886 - DNA, 1586 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaaggtgagtccaggagatgtttcagccctgttgcctttagtctcgaggcaacttagacaacggagtattgatctgagcacagcagggtgtgagctgtttgaagatactggggttgggggtgaagaaactgcagaggactaactgggctgagacccagtggtaatgttttagggcctaaggagtgcctctaaaaatctagatggacaattttgactttgagaaaagagaggtggaaatgaggaaaatgacttttctttattagattccagtagaaagaactttcatctttccctcatttttgttgttttaaaacatctatctggaggcaggacaagtatggtcgttaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgcgcgcgcgcgtgtgtgtgtgtgtgtcagcgtgtgtttcttttaacgtcttcagcctacaacatacagggttcatggtggcaagaagatagcaagatttaaattatggccagtgactagtgcttgaaggggaacaactacctgcatttaatgggaaggcaaaatctcaggctttgagggaagttaacataggcttgattctgggtggaagcttggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcac

SEQ ID NO: 193887 - DNA, 570 bp, homo sapiens
tgtgatctctcagcagaatagatttattatttgtattgcttgcagaataaagcctatccttgaaagctctgaatcatgggcagtgagctcagtggtatctggaggacagggcactggccactgcagtcaccatcttctgccaggaagcctgcacctcaggggtgaattctttgccgaaatggattgccaaaacggtcaccagcacatttcccaggagcttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagccttcccagggtttctcctccagcatcttccacattcaccttgccccacaggcttgtgatagtagccttgtcctcctctgtgaaatgacccatggcgtctggactaggagcttattgataacctcagacgt

SEQ ID NO: 193888 - DNA, 27 bp, artificial sequence
  Antisense oligonucleotide
cuuucaaggauaggcuuuauucugcaa

SEQ ID NO: 193889 - DNA, 27 bp, Artificial
  antisense oligonucleotide
ccuggcagaagauggugacugcagugg

SEQ ID NO: 193890 - DNA, 1745 bp, Homo sapiens
  ref <308>: DATABASE ACCESSION NUMBER: NM_003407
  ref <309>: DATABASE ENTRY DATE: 2010-07-18
  ref <313>: RELEVANT RESIDUES: (1)..(1745)
agcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgt

SEQ ID NO: 193891 - DNA, 2559 bp, Homo sapiens
cagcctgacttcagcgctcccactctcggccgacacccctcatggccaaccgttacaccatggatctgactgccatctacgaggtgagtccccgccgcacggcatccccggtacctgcatgcctgagtccgagtccccacctctctagcgccgcaaactccagcccgggacgcttgcctcccttctccaactggggctccctagcgccgcgccctccagcctggggcccctgcctcccgctcagaccagcttggtgatttggaggtgaaaatggaacccgcgacacccggctcttcgctcaaacatgggtggggcggcccatgcaagtggaaagtcggagaacttttctcagaccgaggctgcctggaggcggaagtggcccccatacctggctcacccctagtcgttgctgagggcgtggttttgcgcggaggcgtctctggggctgaagtctcagggtggggggatccgacttctgtctctccagtccctgaccgtagagacagagaaccctaaaaccgaagcaatccggacttccaggtcaactttgcccggtttctccagttgtgaaactggagatcccgacgcgtgggtcatatccggggaggacaagagacccaaaattgggaaacagtggtgcgccctgacttcggggtccccctcttggtccagccggggaagccgggattcctgggtccctcgggataaggcctcggtggtgggtaaactcagaacctccaactctgggttcctggcatccggaacccaggggtttctgcgggcgggtggggctcaggcggggagcccacaaaccggcctggcaagctctagttccctgcagctggggtggggcgtcgccctgcattttcaggtgccttaaccgacccatttccgcagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtg

SEQ ID NO: 193892 - DNA, 970 bp, Homo sapiens
  misc_feature (45)..(45): n is a, c, g, or t
  misc_feature (66)..(66): n is a, c, g, or t
  misc_feature (68)..(68): n is a, c, g, or t
  misc_feature (70)..(70): n is a, c, g, or t
  misc_feature (73)..(73): n is a, c, g, or t
  misc_feature (90)..(90): n is a, c, g, or t
  misc_feature (93)..(93): n is a, c, g, or t
  misc_feature (103)..(103): n is a, c, g, or t
  misc_feature (108)..(108): n is a, c, g, or t
  misc_feature (153)..(154): n is a, c, g, or t
  misc_feature (156)..(157): n is a, c, g, or t
  misc_feature (169)..(169): n is a, c, g, or t
  misc_feature (174)..(174): n is a, c, g, or t
  misc_feature (176)..(176): n is a, c, g, or t
  misc_feature (183)..(183): n is a, c, g, or t
  misc_feature (227)..(227): n is a, c, g, or t
  misc_feature (230)..(230): n is a, c, g, or t
  misc_feature (257)..(257): n is a, c, g, or t
  misc_feature (372)..(372): n is a, c, g, or t
  misc_feature (632)..(632): n is a, c, g, or t
  misc_feature (823)..(823): n is a, c, g, or t
  misc_feature (897)..(897): n is a, c, g, or t
  misc_feature (922)..(922): n is a, c, g, or t
  misc_feature (947)..(947): n is a, c, g, or t
  misc_feature (954)..(955): n is a, c, g, or t
  misc_feature (958)..(958): n is a, c, g, or t
ataaagatcatattagaataaataaagtcggtcataaataaaggncgccattggtttatgggtggngntnggnaacgggtttgggtactngcntttggggggnaattngggcgccagggttccccctcagggggggttccagtgaccaggggnnannggaacctcaggnctatnanaactggnggggcagtgaaggcctattattcacagcacataagattctaggnganagatttgggcagggaagaggtgggggngagggttcattgcctcccttaaatatgctacaatttttttttcccccaagaacctcggaaggcactccatcccccaccatcatgaatactgggcttgcgcacttgggggcctgcnccagcgtgaggtcaggggagtgggttaatgcattctggaaaaggggattacttgattactgtcccccaagtccccacagccctggggtccatgcagagaccacagtgcaagagagcgtggctccccgctgagatccagctgatctgaccgggcagtcactttgtcactcagaaacagagatgcgattgaagatggggagtcgccggggggctgccacgggctggggtggtgcaaaaactcccgcctcgaagacgggagantcagagccccccaggctgctgccgctgctggcatattcatcagggtcggatcccagggactgtacagagggggtccgaaccaggccacccaagggcccccagacgctgataggagtggcccttcggcaggaggggcaacagactgggggtggggtctcttcgagccagggggggtgccaggggcagcaganaaggcagaggggtgacagtggaaggtcccaggtggtggtggggagctggagggcgagaaggagctggaggacanggaagggcgggccaggctggtggtngtggtgaggtccggcggcaaaaggngggcggnnaanctgatgctctgg

SEQ ID NO: 193893 - DNA, 1117 bp, Homo sapiens
  misc_feature (375)..(375): n is a, c, g, or t
  misc_feature (1000)..(1000): n is a, c, g, or t
  misc_feature (1016)..(1016): n is a, c, g, or t
  misc_feature (1018)..(1018): n is a, c, g, or t
  misc_feature (1030)..(1030): n is a, c, g, or t
  misc_feature (1061)..(1061): n is a, c, g, or t
  misc_feature (1065)..(1065): n is a, c, g, or t
  misc_feature (1075)..(1075): n is a, c, g, or t
  misc_feature (1086)..(1086): n is a, c, g, or t
  misc_feature (1088)..(1088): n is a, c, g, or t
gtggggacggaaacatcccgtccccgaccgcacccgcccgaagctgggtcaaggagcccagcaggacgggagcgcggcgcccccgacgcccgggaactggctcccccggttcccatctggtgacctcacctggtcccaccctttcaggtgaacggccaggcccggtgacgtcacttcctgccagaagcacctctctccctcgctccgcccttcacccagacgctcgccaatccgtgtgtggttccgagccggacttcatttccccgaagcgtcgcggcctgaggagacccgttgggtcctcagcgtcttggcggcagttggtggaaccggagcttcgagtccgtccccggtgctgcctgcgcgttcacctgagtntcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggccaattcccaccggactctgcctgagaggtctggagtggtctgccgagtcaagtactgcaatagcctccctgatatccccttcgaccccaagttcatcacctaccccttcgaccagaacagttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagagcagtttaccgaggaagaaatatacaaagacagggatagccagatcacagccattgagaagacttttgaggatgcccagaaatcaatctcacagcattncagcaaaccccgagtnanaccggtggaggncatgcctgttttcccagactttaaaatgtgnttantcatgtaccnaggtgatcttnantaaaccagccccaaggaagagtggggagc

SEQ ID NO: 193894 - DNA, 297 bp, Homo sapiens
  misc_feature (184)..(185): n is a, c, g, or t
  misc_feature (205)..(205): n is a, c, g, or t
ggaatccggattgcttcggttttagggttctctgtctctacggtcagggactggagagacagaagtcggatccccccaccctgagacttcagccccagagacgcctccgcgcaaaaccacgccctcagcaacgactaggggtgagccaggtatgggggccgcttccgcctccaggcagcctcgnngtctgagaaaacgttctccngactttccacttgcatgggccgccccacctatgtttgagcgaagagccgggtgtcgcgggttccattttcacctccaaatcaccaagctggt

SEQ ID NO: 193895 - RNA, 27 nt, Artificial Sequence
  Antisense oligonucleotide
gacuucugucucuccagucccugaccg

SEQ ID NO: 193896 - RNA, 27 nt, Artificial Sequence
  Antisense oligonucleotide
guacucugucuuucgcauccauggcac

SEQ ID NO: 193897 - RNA, 27 nt, Artificial Sequence
  Antisense oligonucleotide
aaucuugaccucaggcuucucauugga

SEQ ID NO: 193898 - RNA, 27 nt, Artificial Sequence
  Antisense oligonucleotide
gauccgacccugaugaauaugccagca

SEQ ID NO: 193899 - RNA, 27 nt, Artificial Sequence
  Antisense oligonucleotide
aucuucaaucgcaucucuguuucugag

SEQ ID NO: 193900 - DNA, 25 bp, Artificial Sequence
  synthetic polynucleotide
gucagggacuggagagacagaagtc

SEQ ID NO: 193901 - RNA, 25 nt, Artificial Sequence
  synthetic polynucleotide
gccauggaugcgaaagacagaguac

SEQ ID NO: 193902 - DNA, 25 bp, Artificial Sequence
  synthetic polynucleotide
caaugagaagccugaggucaagatt

SEQ ID NO: 193903 - DNA, 25 bp, Artificial Sequence
  synthetic polynucleotide
cuggcauauucaucagggucggatc

SEQ ID NO: 193904 - DNA, 25 bp, Artificial Sequence
  synthetic polynucleotide
cagaaacagagaugcgauugaagat

SEQ ID NO: 193905 - DNA, 7014 bp, Homo sapiens
  ref <308>: DATABASE ACCESSION NUMBER: NM_003749
  ref <309>: DATABASE ENTRY DATE: 2010-05-16
  ref <313>: RELEVANT RESIDUES: (1)..(7014)
cggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcagccggggaggggggcggccaccgcccgcgccgggcatcctcaggagccccagagcgcggagggcgcggcgccgccgagcggtgctggcccccgcgggcctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagagtatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgttttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaacaaaaagaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaaatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtgcattgtatttagtctgtattgatcatggatgccctccttaatagccatatgcaataaaataaagtacattatttatgaaatgaaaaaaaaaaaaaaaaaa

SEQ ID NO: 193906 - DNA, 3431 bp, Homo sapiens
  ref <308>: DATABASE ACCESSION NUMBER: NM_006521
  ref <309>: DATABASE ENTRY DATE: 2010-03-04
  ref <313>: RELEVANT RESIDUES: (1)..(3431)
gggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtgcctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttgaaaaaaaaaaaaaaaaaaaaaaaaaaaaaaaaaaaaaa

SEQ ID NO: 193907 - DNA, 497 bp, Homo sapiens
  misc_feature (232)..(232): n is a, c, g, or t
  misc_feature (407)..(407): n is a, c, g, or t
  misc_feature (482)..(482): n is a, c, g, or t
  misc_feature (484)..(484): n is a, c, g, or t
  misc_feature (487)..(487): n is a, c, g, or t
gccaaagttaaaagcgcatcaaacacgcctagcttttattattttaatcacaaacctatagacccctcagtataccctccatggggcctggccccagcaatccaaagctgacaaccttgggtgtaggtatgaggggtgggaatggaggggggagtgtctcttgataactctgaaatggggtgattcctccaaatgaagaactgggtggggaacagaggttggggtggcctanattctcagtatgcggagcaataaaaaaatcagataaacaaatgagggggtacaatatgcttttacaaccctcctccaagcttctgccttgctgggggaaggcttccagtttttcctgggctggggaggtcccaggatagccccttccttcatcctcttgccctgcactgggcggntcctttggggaaggtgcagggcctcatctgactcctcctccttgcctgattacaggggtggggcctgatcacatntnctnttcccccagg

SEQ ID NO: 193908 - RNA, 27 nt, Homo sapiens
auaccuacacccaagguugucagcuuu

SEQ ID NO: 193909 - RNA, 28 nt, Artificial Sequence
  Hs.708291antisense oligonucleotide
cagcaaggcagaagcuuggaggagggru

SEQ ID NO: 193910 - RNA, 27 nt, Artificial Sequence
  Hs.708291antisense oligonucleotide
cuguaaucaggcaaggaggaggaguca

SEQ ID NO: 193911 - RNA, 27 nt, Artificial Sequence
  Hs.708291antisense oligonucleotide
cucccaacucccuacuuucugucucuu

SEQ ID NO: 193912 - RNA, 27 nt, Artificial Sequence
  Hs.708291antisense oligonucleotide
gccuggguuuguucccaacuggugguu

SEQ ID NO: 193913 - RNA, 27 nt, Artificial Sequence
  Hs.708291antisense oligonucleotide
cuggguauacuuaagauugacgugcuc

SEQ ID NO: 193914 - DNA, 25 bp, Artificial Sequence
  Hs.708291sense oligonucleotide
agcugacaaccuuggguguagguat

SEQ ID NO: 193915 - DNA, 25 bp, Artificial Sequence
  Hs.708291sense oligonucleotide
ccuccuccaagcuucugccuugctg

SEQ ID NO: 193916 - RNA, 25 nt, Artificial Sequence
  Hs.708291sense oligonucleotide
acuccuccuccuugccugauuacag

SEQ ID NO: 193917 - RNA, 25 nt, Artificial Sequence
  Hs.708291sense oligonucleotide
gagacagaaaguagggaguugggag

SEQ ID NO: 193918 - RNA, 25 nt, Artificial Sequence
  Hs.708291sense oligonucleotide
ccaccaguugggaacaaacccaggc

SEQ ID NO: 193919 - RNA, 25 nt, Artificial Sequence
  Hs.708291sense oligonucleotide
gcacgucaaucuuaaguauacccag

SEQ ID NO: 193920 - DNA, 4759 bp, Homo sapiens
  ref <308>: DATABASE ACCESSION NUMBER: NM_014314.3
  ref <309>: DATABASE ENTRY DATE: 2010-04-19
  ref <313>: RELEVANT RESIDUES: (1)..(4759)
tagttattaaagttcctatgcagctccgcctcgcgtccggcctcatttcctcggaaaatccctgctttccccgctcgccacgccctcctcctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacagtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaagtttatgagttggttttttttcattttctatttgtattttattaagagtgtcttttcttatgtgattttttttaattgctatttgatatggtttggctatatgtccccacccaaatctcatcttgaattataatccccatgtgtcaagggagggacctgacgggaggtgattggatcacgggggcagttgtccccatgctgttcttgggatagtgagttagttctcatgagatctgatggttttataagtgtttgacaattcctcctttacacacactctctctctcatctgctgccatgtaagacttgcctgcttccccttctgccatgattgtaagtttcctgaggcctcctcagccatgtggaactgtgaatctattaagcctcttttctttataaatgaaaa

SEQ ID NO: 193921 - DNA, 3434 bp, Homo sapiens
  ref <308>: DATABASE ACCESSION NUMBER: NM_022168.2
  ref <309>: DATABASE ENTRY DATE: 2010-05-16
  ref <313>: RELEVANT RESIDUES: (1)..(3434)
gccccgctgcccacctgcccgcctgcccacctgcccaggtgcgagtgcagccccgcgcgccggcctgagagccctgtggacaacctcgtcattgtcaggcacagagcggtagaccctgcttctctaagtgggcagcggacagcggcacgcacatttcacctgtcccgcagacaacagcaccatctgcttgggagaaccctctcccttctctgagaaagaaagatgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgattaatgtattcattatgctacagaactgacataagaatcaataaaatgattgttttactctgcaaaaaaaaaaaaaa

SEQ ID NO: 193922 - DNA, 876 bp, Homo sapiens
  ref <308>: DATABASE ACCESSION NUMBER: NM_024013.1
  ref <309>: DATABASE ENTRY DATE: 2010-05-16
  ref <313>: RELEVANT RESIDUES: (1)..(876)
agaacctagagcccaaggttcagagtcacccatctcagcaagcccagaagtatctgcaatatctacgatggcctcgccctttgctttactgatggtcctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacatctggtccaacatgaaaacaattcttattgactcatacaccaggtcacgctttcatgaattctgtcatttcaaagactctcacccctgctataactatgaccatgctgataaactgatttatctatttaaatatttatttaactattcataagatttaaattatttttgttcatataacgtcatgtgcacctttacactgtggttagtgtaataaaacatgttccttatatttactc

SEQ ID NO: 193923 - DNA, 1267 bp, Homo sapiens
tctttcaccccatctttattctctgctccatgaggaaagaaaaacagcttcctcctcattctgatttctttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtcccttcacaaccacaactgtcataccgttcatcccttattcctccagaatgaaacaccaccaaatcctgaagcgtccaccatggaaatcagttcttggatacctctgggctgtctacatgttaagatggctgcagagtgaccagagaattctggggcgggggatggggagtgctctagtgacagcaggccacacacagacaatggacagtacagctggggcgctggggaagaaagcagtctgccagtactctgctcatccctctccctttcctgttcttgcagattgccctaaagagctccaagcttttgccctctgttctgcagagttccttccttccgttaaaacccatatacagggaccaggatgctcaaacccaaaccccaaacccttatcaaagcacccacaaaaggggggctcacccctagaaccataattccctttagtcttaagaatataagattttccctacctcgttatacttttactaagcctttttttgtttgtttttttgagacggagtcttactctgttgcccaggctggagtgcagtggcgcgatctcggctcactgcaagctctgcctcccgggttcacgccattctcctgcctcagcctcccgagtagctgggactacaggtgcccgtcaccgcgcctggctaattttttgtatttttagtagagacggggtttcaccgtggtctcaatctcctgacctcgtgatccacccgcctcggcctcccaaagtgctgggattacaggcatgagccaccgcgcccggcctttactaagcctttgaaagcaaatccttcccctttgagcagggcagctgggcctggtcatgtatgataggacagggataccaacacaactcaggcttcccagctgccagtaactcccagctacactggttatagggcttcttgttccctaccatctctgcctatctatctgtaagtgttacgggaaccccaaatgctattacatagcctgattcaacagatacttaacccatttcctcctc

SEQ ID NO: 193924 - DNA, 586 bp, Homo sapiens
  misc_feature (414)..(414): n is a, c, g, or t
  misc_feature (442)..(442): n is a, c, g, or t
  misc_feature (452)..(452): n is a, c, g, or t
  misc_feature (529)..(529): n is a, c, g, or t
  misc_feature (580)..(580): n is a, c, g, or t
  misc_feature (583)..(583): n is a, c, g, or t
gagacggagtcttactctgttgcccaggctggagtgcagtggcgcgatctcggctcactgcaagctctgcctcccgggttcacgccattctcctgcctcagcctcccgagtagctgggactacaggtgcccgtcaccgcgcctggctaattttttgtatttttagtagagacggggtttcaccgtggtctcaatctcctgacctcgtgatccacccgcctcggcctcccagagtgctgggattacaggcatgagccaccgcgcccggcctttactaagcctttgaaagcaaatccttcccctttgagcagggcagctgggcctggtcatgtatgataggacagggataccaacacaactcaggcttcccagctgccagtaactcccagctacactggttataggggcttcttgntccctaccatctctggctatctatctgnaagtgttacnggaaccccaaatgctattacatagcctgattcaacagatacttaacccatttcctcttacccaattcttatcctggngtgctggctacaaaagaatgcctacatttggctagccttttttttcttaanaanttt

SEQ ID NO: 193925 - DNA, 741 bp, Homo sapiens
gcagttctggggaaaccattagtaatttgtgatcgtagagatttgtctcccagtattccctagggcaaaaatattgggagttcctagtcacctaaatgaagaaccttatttttagcagtttccctttcagggctctaacaggactgtggagtaatgtacggggttatgtaggagcaatgcagagccacttttgaaaaacagtagccaaggttctactggctgccttcttaggacattattaaatatcataaacacaagtggaatttaacacccagccagtttgtgttcaaccagacagcgtcattatgaacaaagattatataacgatagctgatattaagtaagttttaaaagttgacatcccaagagtgaagcctacttattcagtacagatttgttgaatgaaattcgtagttttattttacggcataatgaaacagagttccagacatgtacctgccaaatttggttctggttgtcttatcgtatgcaggctggatacctgctactgtgcttctacaggatgttaacagtgtcccctgagtaaaacagttccacggtcagtacatttgggaaccactgagttaaatgggttttatcactgcagaacagacacaagaacaatgtgtgctgtaaatcactgtttgcaggggaaggtggcagcaaatggcacagaaacccacctgaccacagactgctttcttctgggcgttcacgcactgtgctccacaggatactctt

SEQ ID NO: 193926 - DNA, 251 bp, Homo sapiens
ccctaaaagttttaataggttacttttataagacatttacagttcaatgagctgataaggtaattataggatcacatacatgtgggaattaagaaatgtgtatgaatgagtcagaaaaaaaataaagccaaggtaagtgtatggatttgtaatcaggacatcagaagctaaaagactaactctaaaatagtaaaggaatttgaagtagctagaggggtaaacaagcaaaaaaaagagctcataataaatat

SEQ ID NO: 193927 - DNA, 681 bp, Homo sapiens
ggccggggaaagcgaattctctctgacaccaagaccaacgctctagcaaagctcctccggcggatattttgttttcccagcaggttctgccttaacaataaggtcctttgtaggccaaaatgtgcagggcataaaagcatgtgatttgggactttccaaaggggaagtgaacagaaactgccacagacccggacgtgaacagggagttaccctcggctggtgaatgtaggcaggcctggctgagggtggtgagactgcgagggacaggtgagagatgaagctcagaagacatctttgcagagatgtggagaagacaggaggaagtccttcctaaaataaacctgacctcctattgctggtatttatgcagctttgaccaggacctggtaacagatgtggatggacttgaaccaccaactcagcttagaaggaagccaagacttaaagtttcctagatcccagctttttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctgga

SEQ ID NO: 193928 - DNA, 580 bp, Homo sapiens
gatgccgaactgcttcaagttcatctctgttctctattccctgatatatcaaggtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccgcctcctgttattggctaaggccattttgtgactacactgcaggtagagacagattccctggaagtaccttctcaaggccagtgtagagctcccaatcacccagcagattctccctctcccactgcccgcaccaagcaggtctccaggtgttccagctgctgatgaagtccagtgtggagttggtccaggagggtcgtgttccaggcagcagaggagcgctctgtgtggaagaggctgaagatctgctgcagcatctcaggaggacagacagggcctgggcctgctgcaactggctgtcatacacatctc

SEQ ID NO: 193929 - RNA, 27 nt, Artificial Sequence
  Antisense Oligonucleotide
aaccaguguagcugggaguuacuggca

SEQ ID NO: 193930 - RNA, 27 nt, Artificial Sequence
  Antisense Oligonucleotide
uaagaauuggguaagaggaaauggguu

SEQ ID NO: 193931 - RNA, 27 nt, Artificial Sequence
  Antisense Oligonucleotide
caggagauugagaccacggugaaaccc

SEQ ID NO: 193932 - RNA, 27 nt, Artificial Sequence
  Antisense Oligonucleotide
gguggguuucugugccauuugcugcca

SEQ ID NO: 193933 - RNA, 27 nt, Artificial Sequence
  Antisense Oligonucleotide
ugguugaacacaaacuggcuggguguu

SEQ ID NO: 193934 - RNA, 27 nt, Artificial Sequence
  Antisense Oligonucleotide
aagaguauccuguggagcacagugcgu

SEQ ID NO: 193935 - RNA, 27 nt, Artificial Sequence
  Antisense Oligonucleotide
uucuuaagacuaaagggaauuaugguu

SEQ ID NO: 193936 - RNA, 27 nt, Artificial Sequence
  Antisense Oligonucleotide
gggaugaacgguaugacaguugugguu

SEQ ID NO: 193937 - RNA, 27 nt, Artificial Sequence
  Antisense Oligonucleotide
gccuguaaucccagcacuuugggaggc

SEQ ID NO: 193938 - DNA, 20 bp, Artificial Sequence
  Antisense Oligonucleotide
gcttctgatgtcctgattac

SEQ ID NO: 193939 - DNA, 19 bp, Artificial Sequence
  Antisense Oligonucleotide
catacacttaccttggctt

SEQ ID NO: 193940 - DNA, 21 bp, Artificial Sequence
  Antisense Oligonucleotide
cctctagctacttcaaattcc

SEQ ID NO: 193941 - DNA, 20 bp, Artificial Sequence
  Antisense Oligonucleotide
agtctcaccaccctcagcca

SEQ ID NO: 193942 - DNA, 20 bp, Artificial Sequence
  Antisense Oligonucleotide
cttcctcctgtcttctccac

SEQ ID NO: 193943 - DNA, 21 bp, Artificial Sequence
  Antisense Oligonucleotide
gagcgttggtcttggtgtcag

SEQ ID NO: 193944 - DNA, 20 bp, Artificial Sequence
  Antisense Oligonucleotide
gcagtttctgttcacttccc

SEQ ID NO: 193945 - DNA, 20 bp, Artificial Sequence
  Antisense Oligonucleotide
tctctcacctgtccctcgca

SEQ ID NO: 193946 - DNA, 20 bp, Artificial Sequence
  Antisense Oligonucleotide
gccctgtctgtcctccatga

SEQ ID NO: 193947 - DNA, 21 bp, Artificial Sequence
  Antisense Oligonucleotide
tcttcagcctcttccacacag

SEQ ID NO: 193948 - DNA, 20 bp, Artificial Sequence
  Antisense Oligonucleotide
gatttcactcaaccacacgg

SEQ ID NO: 193949 - DNA, 19 bp, Artificial Sequence
  Antisense Oligonucleotide
gggagggtggtctgaaact

SEQ ID NO: 193950 - DNA, 25 bp, Artificial Sequence
  synthetic polynucleotide
ccaguaacucccagcuacacuggtt

SEQ ID NO: 193951 - DNA, 25 bp, Artificial Sequence
  synthetic polynucleotide
cccauuuccucuuacccaauucuta

SEQ ID NO: 193952 - DNA, 25 bp, Artificial Sequence
  synthetic polynucleotide
guuucaccguggucucaaucucctg

SEQ ID NO: 193953 - RNA, 25 nt, Artificial Sequence
  synthetic polynucleotide
gcagcaaauggcacagaaacccacc

SEQ ID NO: 193954 - DNA, 25 bp, Artificial Sequence
  synthetic polynucleotide
gcacugugcuccacaggauacuctt

SEQ ID NO: 193955 - DNA, 25 bp, Artificial Sequence
  synthetic polynucleotide
gcacugugcuccacaggauacuctt

SEQ ID NO: 193956 - RNA, 25 nt, Artificial Sequence
  synthetic polynucleotide
ccauaauucccuuuagucuuaagaa

SEQ ID NO: 193957 - RNA, 25 nt, Artificial Sequence
  synthetic polynucleotide
ccacaacugucauaccguucauccc

SEQ ID NO: 193958 - RNA, 25 nt, Artificial Sequence
  synthetic polynucleotide
cucccaaagugcugggauuacaggc

SEQ ID NO: 193959 - DNA, 1769 bp, Homo sapiens
  ref <308>: DATABASE ACCESSION NUMBER: NM_000446.5
  ref <309>: DATABASE ENTRY DATE: 2010-06-06
  ref <313>: RELEVANT RESIDUES: (1)..(1769)
aatcggcgctgccccagcagggctgcggctgcaggcaggcagagcctcctagcccgtcggtgtctgcgcccatcgatccctttgtctatccccgaccatggcgaagctgattgcgctcaccctcttggggatgggactggcactcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctggaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaattattccaaaaaaaaaaaaaaaaaaa

SEQ ID NO: 193960 - DNA, 534 bp, Homo sapiens
ctagtgagaaggatttttatggtaaatgaggttttcaagtattccaagactgatttgatagtgtattctcaaaaaaaagccctacacatcatatcactcccagttaaacagtgctttgatgcttcatgatgtccacatttagggtcagcattcattgttcagctaagaacactgggtcctcggaatatggcaagcggttgaaataatggcctcagtttctatggcatgggtgcaaatcggtctgttagagctcacagtaaagagctttgtgaaacactgtgccaatcagcagtttccctttgtacacagaggcaactgtactgccttgcaacactgtgccattttctgcataaacctgtgtcactttaggttcttctgttagaatgttctggattcgaagcacctctgatgcaggaggattctctgagtcatagaagaagattttcatgccattgggatggcatccaacccaaaggtctcctgtctcaggatccacagatatgttatccacgagggtattaaagtcaagggact

SEQ ID NO: 193961 - DNA, 21 bp, Artificial Sequence
  Antisense oligonucleotide
tcccttgactttaataccctc

SEQ ID NO: 193962 - DNA, 20 bp, Artificial Sequence
  Antisense oligonucleotide
cctttgggttggatgccatc

SEQ ID NO: 193963 - DNA, 21 bp, Artificial sequence
  Antisense oligonucleotide
cagaggtgcttcgaatccaga

SEQ ID NO: 193964 - DNA, 20 bp, Artificial Sequence
  Antisense oligonucleotide
ggacccagtgttcttagctg

SEQ ID NO: 193965 - DNA, 20 bp, Artificial Sequence
  Antisense oligonucleotide
ttccgaggacccagtgttct

SEQ ID NO: 193966 - DNA, 5927 bp, Homo sapiens
  ref <308>: DATABASE ACCESSION NUMBER: NM_000088.3
  ref <309>: DATABASE ENTRY DATE: 2010-06-06
  ref <313>: RELEVANT RESIDUES: (1)..(5927)
tcgtcggagcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgactggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgctaaaggcgatgctggtccccctggccctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgtgagggggctcctggtgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcctgtcggccctgttggcgcccgtggccccgccggaccccaaggcccccgtggtgacaagggtgagacaggcgaacagggcgacagaggcataaagggtcaccgtggcttctctggcctccagggtccccctggccctcctggctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataa

SEQ ID NO: 193967 - DNA, 5411 bp, Homo sapiens
  ref <308>: DATABASE ACCESSION NUMBER: NM_000089.3
  ref <309>: DATABASE ENTRY DATE: 2010-05-23
  ref <313>: RELEVANT RESIDUES: (1)..(5411)
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 193968 - DNA, 9169 bp, Homo sapiens
  ref <308>: DATABASE ACCESSION NUMBER: NM_000094.3
  ref <309>: DATABASE ENTRY DATE: 2010-03-23
  ref <313>: RELEVANT RESIDUES: (1)..(9169)
  ref <308>: DATABASE ACCESSION NUMBER: NM_000094.3
  ref <309>: DATABASE ENTRY DATE: 2010-03-21
  ref <313>: RELEVANT RESIDUES: (1)..(9169)
gatgacgctgcggcttctggtggccgcgctctgcgccgggatcctggcagaggcgccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcacagcccaccagtgacttcttcttcttcgtcaatgacttcagcatcttgaggacactactgcccctcgtttcccggagagtgtgcacgactgctggtggcgtgcctgtgacccgacctccggatgactcgacctctgctccacgagacctggtgctgtctgagccaagcagccaatccttgagagtacagtggacagcggccagtggccctgtgactggctacaaggtccagtacactcctctgacggggctgggacagccactgccgagtgagcggcaggaggtgaacgtcccagctggtgagaccagtgtgcggctgcggggtctccggccactgaccgagtaccaagtgactgtgattgccctctacgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgcgagtgtcctggagcccagtccctggtgccacccagtaccgcatcattgtgcgcagcacccagggggttgagcggaccctggtgcttcctgggagtcagacagcattcgacttggatgacgttcaggctgggcttagctacactgtgcgggtgtctgctcgagtgggtccccgtgagggcagtgccagtgtcctcactgtccgccgggagccggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgcgaggcagagaggagggccctgctgcagtcatcgtggctcgaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctgggtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagcgcagggcttccttctgcactggcaacctgagggtggccaggaacagtcccgggtcctggggcccgagctcagcagctatcacctggacgggctggagccagcgacacagtaccgcgtgaggctgagtgtcctagggccagctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccctccccactgttcccactgaatggctcccatgaccttggcattatcttgcaaaggatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtccagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctcccgggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctcgaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggcccccgaggacgagatggtgaagttggagagaaaggtgacgagggtcctccgggtgacccgggtttgcctggaaaagcaggcgagcgtggccttcggggggcacctggagttcgggggcctgtgggtgaaaagggagaccagggagatcctggagaggatggacgaaatggcagccctggatcatctggacccaagggtgaccgtggggagccgggtcccccaggacccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgaccggggtccccctgggctggatggccggagcggactggatgggaaaccaggagccgctgggccctctgggccgaatggtgctgcaggcaaagctggggacccagggagagacgggcttccaggcctccgtggagaacagggcctccctggcccctctggtccccctggattaccgggaaagccaggcgaggatggcaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtcgaggccccaagggggactcaggcgaacagggccccccaggcaaggagggccccatcggctttcctggagaacgcgggctgaagggcgaccgtggagaccctggccctcaggggccacctggtctggcccttggggagaggggcccccccgggccttccggccttgccggggagcctggaaagcctggtattcccgggctcccaggcagggctgggggtgtgggagaggcaggaaggccaggagagaggggagaacggggagagaaaggagaacgtggagaacagggcagagatggccctcctggactccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacaggggtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggaccccccggcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccggagaccctggggaagatggtcagaaaggggctccaggacccaaaggtttcaagggtgacccaggagtcggggtcccgggctcccctgggcctcctggccctccaggtgtgaagggagatctgggcctccctggcctgcccggtgctcctggtgttgttgggttcccgggtcagacaggccctcgaggagagatgggtcagccaggccctagtggagagcggggtctggcaggccccccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccggggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctggtgacaagggctcagccgggttgccaggactgcgtggactcctgggaccccagggtcaacctggtgcagcagggatccctggtgacccgggatccccaggaaaggatggagtgcctggtatccgaggagaaaaaggagatgttggcttcatgggtccccggggcctcaagggtgaacggggagtgaagggagcctgtggccttgatggagagaagggagacaagggagaagctggtcccccaggccgccccgggctggcaggacacaaaggagagatgggggagcctggtgtgccgggccagtcgggggcccctggcaaggagggcctgatcggtcccaagggtgaccgaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcagggccagaagggtgagcgaggtccccccggagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactccgagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgtgtgcacgtccgttatttcagtgacttggtcccgtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggc

SEQ ID NO: 193969 - DNA, 387 bp, Homo sapiens
ggccattacggccgggcagccaggccccagctgagaataatgcactggatgggggtggttgttgtgttaggggaccccagttctcactgctgctctctggtagtcagaagtgaggggtcagccccatctttcctgctggagtgagctcccagctgggtagctggcagcctttctgtcatatccctccctgctcctgatgtctggaggcagtgtagttcttcttaaaagttggcttggcagggcgcggtggctcacacctgtaatcccaacattttgggaggctgaggcagtcggatcacctgaggtcgagagtttgagaccccagcctatccaacatggtgaaactccatctctactaaaaatacaaaaattagcccggcatggtgg

SEQ ID NO: 193970 - DNA, 561 bp, Homo sapiens
attttggtgggaggccctggacctagaaacagaaaatgaaagtggagaaaaccaaacaagaatctttctttcttaaagtaaacatcggactgacatctcctttcaaacattcattgaggatctactctgtgagaagaagcaataccatgttatctcattctagttccagttctagttgacttgattgtcaaacgactgctaagaagtagagaggaggcttcaccatgtttgccaggctagtctggaactcttgacctcaggtgatccacccacctcggcctcccaaagtgctaggattacaggcatgagccacctcgcccagctgtttctgtgtcacgttttgatacttgaataaaaatgacactttggagccttgaaaaatggactttccttctgaagtacccaggagagtaggatggacttcttcctctctccctacactatcccttggagaaaaccttttatcaagaagataccgaatatcatcactgatataatgtcagaggaggtcactctctatagcccaacctccaggatttcagcacttcgtggacatggagg

SEQ ID NO: 193971 - DNA, 335 bp, Homo sapiens
gggaccagagagctgcgatatggctgaaaaaagtgagtgcaagacaaggacataggatgaaaggggccagtgatggtcagggacactggaggacaggagtctgtgggatcttagcatgtaggatgacaggagtcagtggactgcagtgagaactgatgagccattgacagacactgatgtgggatggcagaggtcagtgctggatggggacatgcaatgagaggttggtgtacagtggtcaccactagggtaacagaaagacaggtgattgagcttgtggctgtgcagaggtgaaagccgaggatggtgtgtgggcagataggagattggttgtt

SEQ ID NO: 193972 - DNA, 613 bp, Homo sapiens
ttttttttttttttttttaagagaagatgtctcgctccgtcgtccaggctggagcgcagtggcgcaatcatggatcactgcagccttgaccttcccgggctcaagcgatcctcccggctcacccccagtagctggaaccacaggcgcgcttccacaccggaaagcccattttctagaggcggaaaccgaagcgcccagtgggaaaggcgacccgccggggatgcggggtgctcaacgcgctgccacctggggcccaacgcgttgacctcgcggtcaggttgcttccgcggactacggttctggctcgctagctctggaacaggcaggaaggagtggggctatctgataggggaagatgatgggagtctaacaggagacgggaatttgatagaggagatggtgaataggtccagtggaggagtggggaggtggaggttttaggaagcagtgagcaggtctgatggaggagaaagtgtaaatctcagaggagatttgggtccagcaaaaaagggatggggtagggtaggggcagacacaccctgttgacagttcagggctcagtgccatcttgggaagcagatggataacgagacagggaggagactatagggac

SEQ ID NO: 193973 - DNA, 177 bp, Homo sapiens
tcccaccgggtccaggtcaggcccaaggggaccagctctgctcccaccatcatcccactccccacacagccaagctggacatctgagagcactgcatggcaatcctcatctgcctgtgtgtctccctccactggggacacatgtcatgtgtcagtcctgcagcacatgtgtccttct

SEQ ID NO: 193974 - DNA, 285 bp, Homo sapiens
gaactcagacatgcgaccaagaattggctcacaggagctcagacatgaccatggcctatctcaggacagcacagacagagggacgctcagatactaccatagacaggtgggagttcaggcatggcacaggcacagggagcccacacgcgagtgcagacatctggctccacagacgtgagtgcggacacacgggcgctcagaggggaaccccaacacgtccactcccgggtagagcaggcatggccacaggcttgaacgctgggagccagaggcagggacaagcag

SEQ ID NO: 193975 - DNA, 20 bp, Artificial Sequence
  Antisense oligonucleotide
acatcaggagcagggaggga

SEQ ID NO: 193976 - DNA, 20 bp, Artificial Sequence
  Antisense oligonucleotide
ccctaactcaacaacatccc

SEQ ID NO: 193977 - DNA, 21 bp, Artificial Sequence
  Antisense oligonucleotide
tctcaaactctcgacctcagg

SEQ ID NO: 193978 - DNA, 21 bp, Artificial Sequence
  Antisense oligonucleotide
gtttcaccatgttggctaggc

SEQ ID NO: 193979 - DNA, 20 bp, Artificial Sequence
  Antisense oligonucleotide
gcctcctctctacttcttag

SEQ ID NO: 193980 - DNA, 21 bp, Artificial Sequence
  Antisense oligonucleotide
gggatagtgtagggagagagg

SEQ ID NO: 193981 - DNA, 21 bp, Artificial Sequence
  Antisense oligonucleotide
cctactctcctgggtacttca

SEQ ID NO: 193982 - DNA, 20 bp, Artificial Sequence
  Antisense oligonucleotide
ggtgtctgtcttccttaggg

SEQ ID NO: 193983 - DNA, 20 bp, Artificial Sequence
  Antisense oligonucleotide
aattagctgggcgtggtggc

SEQ ID NO: 193984 - DNA, 20 bp, Artificial Sequence
  Antisense oligonucleotide
aatcccagctgctcaggagg

SEQ ID NO: 193985 - RNA, 27 nt, Artificial Sequence
  Antisense oligonucleotide
gcucaaucaccugucuuucuguuaccc

SEQ ID NO: 193986 - RNA, 27 nt, Artificial Sequence
  Antisense oligonucleotide
cugccaucccacaucagugucugucaa

SEQ ID NO: 193987 - RNA, 27 nt, Artificial sequence
  Antisense oligonucleotide
cuccuccaucagaccugcucacugcuu

SEQ ID NO: 193988 - RNA, 27 nt, Artificial Sequence
  Antisense oligonucleotide
gucccuauagucuccucccugucucgu

SEQ ID NO: 193989 - DNA, 20 bp, Artificial Sequence
  Antisense oligonucleotide
ggagtgggatgatggtggga

SEQ ID NO: 193990 - DNA, 21 bp, Artificial sequence
  Antisense oligonucleotide
gcagtgctctcagatgtccag

SEQ ID NO: 193991 - DNA, 20 bp, Artificial Sequence
  Antisense oligonucleotide
tggagggagacacacaggca

SEQ ID NO: 193992 - DNA, 21 bp, Artificial Sequence
  Antisense oligonucleotide
tccctctgtctgtgctgtcct

SEQ ID NO: 193993 - DNA, 20 bp, Artificial Sequence
  Antisense oligonucleotide
gcctgaactcccacctgtct

SEQ ID NO: 193994 - DNA, 20 bp, Artificial Sequence
  Antisense oligonucleotide
ctctggctcccagcgttcaa

SEQ ID NO: 193995 - RNA, 25 nt, Artificial Sequence
  synthetic polynucleotide
guaacagaaagacaggugauugagc

SEQ ID NO: 193996 - RNA, 25 nt, Artificial Sequence
  synthetic polynucleotide
gacagacacugaugugggauggcag

SEQ ID NO: 193997 - RNA, 25 nt, Artificial Sequence
  synthetic polynucleotide
gcagugagcaggucugauggaggag

SEQ ID NO: 193998 - RNA, 25 nt, Artificial Sequence
  synthetic polynucleotide
gagacagggaggagacuauagggac

SEQ ID NO: 193999 - DNA, 5517 bp, Homo sapiens
  ref <308>: DATABASE ACCESSION NUMBER: NM_101395
  ref <309>: DATABASE ENTRY DATE: 2010-06-20
  ref <313>: RELEVANT RESIDUES: (1)..(5517)
gggagcgcggcgcgggagcccgaggctgagactcaccggaggaagcggcgcgagcgccccgccatcgtcccggctgaagtgcagtggcacgatcataggtggtcactacagtctcagattcctgggcttaagcagtcttcccacctcagcctccccagtagctgggattacagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgagctcgcacgtggttcatttgcttgtgtcacctgccattctcaggtggagcagcactggatgccaggtgcctttagaatgaccgtatcatttaccctagaggttcatgacgttcctgtctaaggaaatgtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgttttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtcctcagactctttactatgcttttttaaaaattaatttaagaaaaatgtaaacatagtaaaaatcttcctatgcaattaaactggtccaggtctggtaggtatagtatcaaagttgagttaaatgtgtaaaaaggaaactatttgagatacattgacataggcatcagcaatctctgaaagtaaaaattggaggtttaacaga

SEQ ID NO: 194000 - DNA, 2457 bp, Homo sapiens
  ref <308>: DATABASE ACCESSION NUMBER: NM_004414
  ref <309>: DATABASE ENTRY DATE: 2010-04-19
  ref <313>: RELEVANT RESIDUES: (1)..(2457)
ggagcgcgtgaggctccggcgcgcaagcccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaaaaaaaaaaaaaaaaaaaaaaaaaaaa

SEQ ID NO: 194001 - DNA, 3814 bp, Homo sapiens
atctgttaaacctccaatttttactttcagagattgctgatgcctatgtcaatgtatctcaaatagtttcctttttacacatttaactcaactttgatactatacctaccagacctggaccagtttaattgcataggaagatttttactatgtttacatttttcttaaattaatttttaaaaaagcatagtaaagagtctgaggacaaattattcaactgtttatcatacataagaccgcatgactataatacaaaggggggttcttttttcatttaacgttacaatatacacagcaagtccggactagatcttacaatctgaacacaggtatttaaccttttccatgctgtttatgtttacaatgcacagaagtcctgtaaccaaactgtgtagtaaagcacacaaaactggactgtaacataacacagtatgcagaagcattggattttatgattttctttacgtaaatatcggtttaaaaactgctttagttttttggtgcttgctaagatgtggcaaccagcacagaaaaaaaaaatgacctgacccatatgatatcttaaccttatattcctaaacagcagtaactactgaattccttttgatattgctatactcaagatgatatccttttattcactgtaaacctttatgaactaccaagttcaaaaaaatcatccacaggcttgacagttaattacaaaataaatatggatttcctgataaacaacaaaaagtttttgtagtttataaaaacgagtatttccaagtttccattcacatttacatagtgtttagcctttcttttctcactgtttacatataaaaacctgcttttgttcagaaaaaaaattgacctagtcagccacatggaattgaccaatagaatgaaacgcggtgttctgctgagtcatcttaaacaggttatcggcagaggtagattactgcttcttttctaggcttcttttgatcctggacaggtaaattacttatcttcattctcccaattcaaccgctcaaaagtgtcacaccccaaaattggtcaatttaaaatgggaacacaaatttagcaactgccagactgtgttacattaaggcagcgtaatctcaacacgaggcacctgttaaataccagcctgtctgctcaggtcacgcatgagagttctgctttgcttgcactcatactctggacctgttggtgcaatcaaggtcttgctttcaagtttacaagtaggttaatcaggaatacaagaatcaactgctggttccatagcttctggatccagtgtccctttaccttcagaagcctgaacacacttagaatgtaacagatgttgtaatcttgaattagatgtcaatctactatgttcagtacacagattgctgtaaatgtattggctatggattcaacaacagttccagttttgtttaagcaatagtacagccataattttcaactgacatttaaaaatggtctagttacaccttgtgtcaaagtgcagaactgctacattattggttacagacatctatgtgctataaaaacagctttggtacaataaattatcaaaaaagaaaataaatttttgtaaaattcacagcataattgtgaggcaaaaaagcagtcacataaaattctgcattttttaaaaatgttcaggatgaacagaagacatctttgtgcagaagaaatggtggagataccacgtgccgagaaaaagcaaaagaaaaagtaaaaagcaggaagggacacagctgtagctatttccatcaaagcaaaccactacttctgtgaccttcaaccaataaggaagtcaactttatgacacacgcaaagtgaccttgcaataccttacaattagtgggtcacaaaagtctattttaaaagaaaggcctcttgaattacccattctctgtgttttcagcattaaggactgtctgcaaaagcatgtccaaaagtgattgcatctgaaatggtaggctcttctaatttcgagtccaaatccataaggccaaaggttatcccaaagaccaccactcagacctccccaggactggccacgaccgacccgttgattgcttctcagtgcaccttggttaggagaccagtcacgttccatcctatcttcctgtggcctctgcaacgggagagccacaggatcccatgtaattgctgctttgctcctcagtaggttcagataggagagttctgatccccgccactcagcatgcttactgtgcctgacaaacttcaccacaaccgtccctttcatacagctgaagatggtgtttgtggaagctggaggtccctcttccttacagtactgcatttccgtgcccaagtgtgtttagaggacttaaaaacccaaatttcccaccctcccacccaaaacaaaacagaacaaaacaaaaaaaaagggggatgggggggacaaaaagaaaaaaaaaaaacaccctcatggggccctttatgcaaattatgtgcagtgccttttactttaaaattagttggcaaatgaccaagaccaacatctgaatattaacttttgctgaatagaaagacaaaaaaaccccactgtgactgggatgtggcaagttaaaatgggggagcaaaaagaggatacctctgagctatccatgaagatgggtttggacatggctcttttaaacacttcaatgtccctttgcaatcttttcaagttaaaaaaaaaatcagctttgccctcttgtagcggttcagtgtgttaatctcctcctgattcaagcagctttgcactttgtttttggaaaaaaaacaccacttctataaaaacacacaagaaacaaactcaagtttcaatgtagtcacgagctagctacaggactctgttgcacacaaactcctgtcatgggggactcttctctatcagccccttgcctcattgtcagatgtccttcagtcatgtaatgtgcaggacctgtattagcagaaaattggtatgttggatgtccagctatgccagtctcttggcggggattggagtagacggtcaaattaacgtccatagctccattctgtccaaagtccaaggtattagcagccactgggcgattctggtaggcctgattgccttggttaccagtagaggaggaagatgtcgaggaagaagtcgttgaggaagacagggatgtcatggagtggtgactgtggccaacctccatagaatcttgggtagaggagctattcgttggagaattgtagacccttggcctggtccggttacccaaggcttgttgtccatggtggtggtgatggtggtggtggtggtgatggtgatgggaactgttaccatggtgatgatgcaatgcattctgttgaggggctacatgaaaggttgtttcttgaacaggatgagtttcaacagtgacctgtgtaggagagcccgaaccgcccgcccccgagtccccgcacagacagacagacactcgcacacacccgcacactcgcgcgcacaatcgccctcgcacacgctccctcgcacacacactcgcactcacaccggtcccgcctgctcgccggcggcggcagcggcaccaacagcagcagcaggaacagcagcagcagaagcggcggcggcggcgcccgcaccccccgctcggggtgtccgctctctgaggccgacctgggccgcgatcagcagcagcgacagcagcagtctccccggatacccccgccgcggttgccgccgccacccccgcctcactccaatggggctttttattattattcgggcgggaagcgaaagggtttaaaaaaaaaccaaccaacaaaa

SEQ ID NO: 194002 - DNA, 633 bp, Homo sapiens
atggcgacggaccgacccggtcgctatagcaactgtcaatcaaaacgcaaaaccccggctgacgtgctgacgtcctcctcccgccccccagccccgagccggcgggcggggcctgttgctcaggtaacggcagattccgttccctcctttccgtctccccctctgtccccagccaaccacccaaccccctcaggtcacgtgaaggataaattcggagctcgggtccgctacgaccccgcccgcgccggggggaggggcgggctgccccgggcgggggagggggaggaggaggggcgccgcggccttcgggcggggacccgggaagcccaccccgcgcgcccgggcctggagggctctcaccgcggtccgggcgccgcgctcgcctctctccccgggaagcgcggcggccgcgaccgtccgcgcgtggagccggttcttcgaagggctggcgggcctcctagccggaaaatgccggcggaggccgtggtgggggcggggaggagccaccgccgcgccccagacatcgcaggaattccggacgctgcgccgggcccggcggccctgaggctggcacctggctccggtcgggccgcccaggttttgtggcgcccgagaccagcgttgggaaattag

SEQ ID NO: 194003 - DNA, 497 bp, Homo sapiens
ttttttttttttttcttgaagactaagcttacagaatcatgtgactatatataaagaagtttgatccagtcttttttcctcacaccatcactctccagatccaacagactggctaaggaggggacggccagacccccagggacttttgtcagcattgcagttaatgatctgtttacacaaggggagataccaccaacctaaagtagatttacatttacattacatcatccaaaggtgacaccccagtcttaacagtaagactgccacattgaaaccgcagaaactacatattcccacctagaaggatggtttcagctaaatgagaaatggtccacttgctgcaaggcttaccaaggacccgctgtgactttagctctcaggttgcccactgcatagagctatttgccctcagagactgggactcccttagcccacctggtttttgggttttcactgattgctgtatatctcacaggaccctagaattggacatcagt

SEQ ID NO: 194004 - DNA, 545 bp, Homo sapiens
aaaaaaaccacttcacagatgaacgtgtcctgaaagggggcttatataccttggatatatgatccgccctcctgacaagccacagcagcacttaaaaaggcttgtgaagggatgatgccagtggaagaaaacaggaactttgacctcccagagcctatggataccaagaagggatcagatgactgattttttcaaaagcttcctggtggaataaatgcatttcacaggactcacatgaatgaacgtctctggacacctaatcaccatttatcaatctcacttctatgagaaaaacacatttcaagtacctaccctccagcttgtcaacaaattcattaaaaaagaagggaacatcagttatataaagccatggtgtttttgccttactatcaagcttttggatgaaatggaaaagttaaatccgcccgggaggcatttctaactctccacatttagccacggaatagttagactaatacctgaattctccatttacattttcagcttgcattcacagatctggagtcatagagaaattactggtg

SEQ ID NO: 194005 - DNA, 20 bp, Artificial Sequence
  Antisense oligonucleotide
gaatctgccgttacctgagc

SEQ ID NO: 194006 - DNA, 20 bp, Artificial Sequence
  Antisense oligonucleotide
gaattcctgcgatgtctggg

SEQ ID NO: 194007 - DNA, 20 bp, Artificial Sequence
  Antisense oligonucleotide
gctccgaatttatccttcac

SEQ ID NO: 194008 - DNA, 21 bp, Artificial Sequence
  Antisense oligonucleotide
tcccatcaccatcaccaccac

SEQ ID NO: 194009 - DNA, 20 bp, Artificial Sequence
  Antisense oligonucleotide
gccacatcttagcaagcacc

SEQ ID NO: 194010 - DNA, 20 bp, Artificial Sequence
  Antisense oligonucleotide
gccacatcccagtcacagtg

SEQ ID NO: 194011 - DNA, 19 bp, Artificial Sequence
  Antisense oligonucleotide
gccacatcccagtcacagt

SEQ ID NO: 194012 - DNA, 19 bp, Artificial Sequence
  Antisense oligonucleotide
gctgtgtcccttcctgctt

SEQ ID NO: 194013 - DNA, 21 bp, Artificial Sequence
  Antisense oligonucleotide
ggtctggtaggtatagtatca

SEQ ID NO: 194014 - DNA, 20 bp, Artificial Sequence
  Antisense oligonucleotide
gggtccttggtaagccttgc

SEQ ID NO: 194015 - DNA, 21 bp, Artificial Sequence
  Antisense oligonucleotide
ctgatgtccaattctagggtc

SEQ ID NO: 194016 - DNA, 20 bp, Artificial Sequence
  Antisense oligonucleotide
ggagagtgatggtgtgagga

SEQ ID NO: 194017 - DNA, 20 bp, Artificial Sequence
  Antisense oligonucleotide
ccctccttagccagtctgtt

SEQ ID NO: 194018 - DNA, 20 bp, Artificial Sequence
  Antisense oligonucleotide
gtcatctgatcccttcttgg

SEQ ID NO: 194019 - DNA, 20 bp, Artificial Sequence
  Antisense oligonucleotide
gctggagggtaggtacttga

SEQ ID NO: 194020 - DNA, 20 bp, Artificial Sequence
  Antisense oligonucleotide
cttgtcaggagggcggatca

SEQ ID NO: 194021 - DNA, 19 bp, Artificial Sequence
  Antisense oligonucleotide
ttctctatgactccagatc

SEQ ID NO: 194022 - DNA, 21 bp, Artificial Sequence
  Antisense oligonucleotide
gcatcatcccttcacaagcct

SEQ ID NO: 194023 - DNA, 21 bp, Artificial Sequence
  Synthetic polynucleotide
gttcacaccattctcctgcct

SEQ ID NO: 194024 - DNA, 20 bp, Artificial Sequence
  Synthetic polynucleotide
agcctgcttctgtgccacct

SEQ ID NO: 194025 - DNA, 19 bp, Artificial Sequence
  Synthetic polynucleotide
ctcctcagtactcggctct

SEQ ID NO: 194026 - DNA, 19 bp, Artificial Sequence
  Synthetic polynucleotide
acaccattctcctgcctca

SEQ ID NO: 194027 - DNA, 20 bp, Artificial Sequence
  Synthetic polynucleotide
tgcctgccacacctgttcct

SEQ ID NO: 194028 - DNA, 20 bp, Artificial Sequence
  Synthetic polynucleotide
ctccatcctgagaactccct

SEQ ID NO: 194029 - DNA, 21 bp, Artificial Sequence
  Synthetic polynucleotide
gccacacctgttcctacctgt

SEQ ID NO: 194030 - DNA, 20 bp, Artificial Sequence
  Synthetic polynucleotide
gcttcttctacactcccaag

SEQ ID NO: 194031 - DNA, 19 bp, Artificial Sequence
  Synthetic polynucleotide
catctgctccctctaccag

SEQ ID NO: 194032 - DNA, 20 bp, Artificial Sequence
  Synthetic polynucleotide
ctctctacctagtgtgcggg

SEQ ID NO: 194033 - DNA, 20 bp, Artificial Sequence
  Synthetic polynucleotide
ctctctacctagtgtgcggg

SEQ ID NO: 194034 - DNA, 19 bp, Artificial Sequence
  Synthetic polynucleotide
catctgctccctctaccag

SEQ ID NO: 194035 - DNA, 20 bp, Artificial Sequence
  Synthetic polynucleotide
tctacacacccaagacccgc

SEQ ID NO: 194036 - DNA, 19 bp, Artificial Sequence
  Synthetic polynucleotide
tctgctccctctaccagct

SEQ ID NO: 194037 - DNA, 21 bp, Artificial Sequence
  Synthetic polynucleotide
gcagaagcgtggcattgtgga

SEQ ID NO: 194038 - DNA, 19 bp, Artificial Sequence
  Synthetic polynucleotide
ccgcagcctttgtgaacca

SEQ ID NO: 194039 - DNA, 20 bp, Artificial Sequence
  Synthetic polynucleotide
tcctgcaccgagagagatgg

SEQ ID NO: 194040 - DNA, 21 bp, Artificial Sequence
  Synthetic polynucleotide
aggttagagtgggagggattt

SEQ ID NO: 194041 - DNA, 21 bp, Artificial Sequence
  Synthetic polynucleotide
gccagctctgcctaattcggt

SEQ ID NO: 194042 - DNA, 21 bp, Artificial Sequence
  Synthetic polynucleotide
tccctggtctggagaggttct

SEQ ID NO: 194043 - DNA, 20 bp, Artificial Sequence
  Synthetic polynucleotide
gtctctccctccctctctct

SEQ ID NO: 194044 - DNA, 21 bp, Artificial Sequence
  Synthetic polynucleotide
gtcccttctcatgcctttccc

SEQ ID NO: 194045 - DNA, 21 bp, Artificial Sequence
  Synthetic polynucleotide
ccttctcatgcctttccctcc

SEQ ID NO: 194046 - DNA, 21 bp, Artificial Sequence
  Synthetic polynucleotide
tgtctgtttcccacctcacct

SEQ ID NO: 194047 - DNA, 18 bp, Artificial Sequence
  Synthetic polynucleotide
agagtgggagggatttta

SEQ ID NO: 194048 - DNA, 19 bp, Artificial Sequence
  Synthetic polynucleotide
ggccagctctgcctaattc

SEQ ID NO: 194049 - DNA, 19 bp, Artificial Sequence
  Synthetic polynucleotide
cctggtctggagaggttct

SEQ ID NO: 194050 - DNA, 19 bp, Artificial Sequence
  Synthetic polynucleotide
cctatgtcccttctcatgc

SEQ ID NO: 194051 - DNA, 18 bp, Artificial Sequence
  Synthetic polynucleotide
ttccctccaacggggaaa

SEQ ID NO: 194052 - DNA, 12 bp, Artificial Sequence
  Synthetic polynucleotide
ggccagctctgc

SEQ ID NO: 194053 - DNA, 12 bp, Artificial Sequence
  Synthetic polynucleotide
cagctctgccta

SEQ ID NO: 194054 - DNA, 12 bp, Artificial Sequence
  Synthetic polynucleotide
cctggtctggag

SEQ ID NO: 194055 - DNA, 12 bp, Artificial Sequence
  Synthetic polynucleotide
tggagaggttct

SEQ ID NO: 194056 - DNA, 12 bp, Artificial Sequence
  Synthetic polynucleotide
ggtctggagagg

SEQ ID NO: 194057 - DNA, 20 bp, Artificial Sequence
  Synthetic polynucleotide
tcctcctccctcagcctctt

SEQ ID NO: 194058 - DNA, 20 bp, Artificial Sequence
  Synthetic polynucleotide
gctggtcttgaactcctggc

SEQ ID NO: 194059 - DNA, 21 bp, Artificial Sequence
  Synthetic polynucleotide
atcctcctccctcagcctctt

SEQ ID NO: 194060 - DNA, 21 bp, Artificial Sequence
  Synthetic polynucleotide
gattacaggcatgcaccacca

SEQ ID NO: 194061 - DNA, 20 bp, Artificial Sequence
  Synthetic polynucleotide
agtgcctctctctgttggtt

SEQ ID NO: 194062 - DNA, 20 bp, Artificial Sequence
  Synthetic polynucleotide
accatttcacccactgctct

SEQ ID NO: 194063 - DNA, 21 bp, Artificial Sequence
  Synthetic polynucleotide
gctgcccacttcagatgcttc

SEQ ID NO: 194064 - DNA, 20 bp, Artificial Sequence
  Synthetic polynucleotide
gtctgtggtttgttgccctt

SEQ ID NO: 194065 - RNA, 27 nt, Artificial Sequence
  Synthetic polynucleotide
guccacuguccugaggcacuggcugag

SEQ ID NO: 194066 - RNA, 27 nt, Artificial Sequence
  Synthetic polynucleotide
ccuccaucucuggagcuccagcugcca

SEQ ID NO: 194067 - DNA, 20 bp, Artificial Sequence
  Synthetic polynucleotide
agttgtccgtgagtccctgc

SEQ ID NO: 194068 - DNA, 21 bp, Artificial Sequence
  Synthetic polynucleotide
ccctctgcccttcttgtcact

SEQ ID NO: 194069 - DNA, 20 bp, Artificial Sequence
  Synthetic polynucleotide
ggcgtcttctcaggtgggta

SEQ ID NO: 194070 - DNA, 20 bp, Artificial Sequence
  Synthetic polynucleotide
ccgccttgtgttgggtctgt

SEQ ID NO: 194071 - DNA, 21 bp, Artificial Sequence
  Synthetic polynucleotide
gccattgccgccactatctgt

SEQ ID NO: 194072 - DNA, 21 bp, Artificial Sequence
  Synthetic polynucleotide
catgtgggtctgtgtgtgtgc

SEQ ID NO: 194073 - RNA, 25 nt, Artificial Sequence
  Synthetic polynucleotide
cagccagugccucaggacaguggac

SEQ ID NO: 194074 - RNA, 25 nt, Artificial Sequence
  Synthetic polynucleotide
gcagcuggagcuccagagauggagg

SEQ ID NO: 194075 - DNA, 20 bp, Artificial Sequence
  Synthetic polynucleotide
ttcctcactcccttctccca

SEQ ID NO: 194076 - DNA, 21 bp, Artificial Sequence
  Synthetic polynucleotide
gccactctgatatagtcccag

SEQ ID NO: 194077 - DNA, 21 bp, Artificial Sequence
  Synthetic polynucleotide
ctttcgctaccactgcttccc

SEQ ID NO: 194078 - DNA, 21 bp, Artificial Sequence
  Synthetic polynucleotide
accaccacactcctacatttc

SEQ ID NO: 194079 - DNA, 20 bp, Artificial Sequence
  Synthetic polynucleotide
atgcccaatcccacccacca

SEQ ID NO: 194080 - DNA, 20 bp, Artificial Sequence
  Synthetic polynucleotide
tccttcccgcagtggctctt

SEQ ID NO: 194081 - DNA, 21 bp, Artificial Sequence
  Synthetic polynucleotide
gctctctcttgcacctgtgga

SEQ ID NO: 194082 - DNA, 20 bp, Artificial Sequence
  Synthetic polynucleotide
gcgtcctcttgagtctgtgg

SEQ ID NO: 194083 - DNA, 19 bp, Artificial Sequence
  Antisense oligonucleotide
tcctctctcccaacccact

SEQ ID NO: 194084 - DNA, 20 bp, Artificial Sequence
  Antisense oligonucleotide
tgtctcggctctccactcct

SEQ ID NO: 194085 - DNA, 21 bp, Artificial Sequence
  Antisense oligonucleotide
cattccttccacaattcgcct

SEQ ID NO: 194086 - DNA, 19 bp, Artificial Sequence
  Antisense oligonucleotide
gttcctcccgtgcctttag

SEQ ID NO: 194087 - DNA, 21 bp, Artificial Sequence
  Antisense oligonucleotide
acctatagtacacgcccagca

SEQ ID NO: 194088 - DNA, 20 bp, Artificial Sequence
  Antisense oligonucleotide
gcttctgcccaggtgtgaca

SEQ ID NO: 194089 - DNA, 19 bp, Artificial Sequence
  Antisense oligonucleotide
cagcaagtgtcagatccca

SEQ ID NO: 194090 - DNA, 21 bp, Artificial Sequence
  Antisense oligonucleotide
agtgtcagatcccagctccag

SEQ ID NO: 194091 - DNA, 21 bp, Artificial Sequence
  Antisense oligonucleotide
ggagtttggtcagtggttggg

SEQ ID NO: 194092 - DNA, 20 bp, Artificial Sequence
  Antisense oligonucleotide
gtgtcagatcccagctccag

SEQ ID NO: 194093 - DNA, 21 bp, Artificial Sequence
  Antisense oligonucleotide
ctcgttacctcttgtcctggg

SEQ ID NO: 194094 - DNA, 20 bp, Artificial Sequence
  Antisense oligonucleotide
agtcgggagggcttgggtta

SEQ ID NO: 194095 - DNA, 20 bp, Artificial Sequence
  Antisense oligonucleotide
ccctgcttccttctgtgtct

SEQ ID NO: 194096 - DNA, 20 bp, Artificial Sequence
  Antisense oligonucleotide
gccaccctgcttccttctgt

SEQ ID NO: 194097 - DNA, 20 bp, Artificial Sequence
  Antisense oligonucleotide
tcctgcttcctcggctctca

SEQ ID NO: 194098 - DNA, 20 bp, Artificial Sequence
  Antisense oligonucleotide
cctccatgtcctgccctcaa

SEQ ID NO: 194099 - DNA, 21 bp, Artificial Sequence
  Antisense oligonucleotide
tccgtctcctccattagtcca

SEQ ID NO: 194100 - DNA, 20 bp, Artificial Sequence
  Antisense oligonucleotide
tccgtctcctccattagtcc

SEQ ID NO: 194101 - DNA, 21 bp, Artificial Sequence
  Antisense oligonucleotide
gtccgtctcctccattagtcc

SEQ ID NO: 194102 - DNA, 21 bp, Artificial Sequence
  Antisense oligonucleotide
ctaccagcatcacctcaaccc

SEQ ID NO: 194103 - DNA, 21 bp, Artificial Sequence
  Antisense oligonucleotide
agttcgaggtgaagaaggagc

SEQ ID NO: 194104 - DNA, 21 bp, Artificial Sequence
  Antisense oligonucleotide
cgctggaggatctgtactgga

SEQ ID NO: 194105 - DNA, 20 bp, Artificial Sequence
  Antisense oligonucleotide
cctgatgaagttcgaggtga

SEQ ID NO: 194106 - DNA, 21 bp, Artificial Sequence
  Antisense oligonucleotide
gtacgtcaacgacttcgacct

SEQ ID NO: 194107 - DNA, 19 bp, Artificial Sequence
  Antisense oligonucleotide
gcaattgaagctgtctccc

SEQ ID NO: 194108 - DNA, 19 bp, Artificial Sequence
  Antisense oligonucleotide
cggcagagaacagaaggtc

SEQ ID NO: 194109 - DNA, 19 bp, Artificial Sequence
  Antisense oligonucleotide
tttcaggagatgggcgctc

SEQ ID NO: 194110 - DNA, 21 bp, Artificial Sequence
  Antisense oligonucleotide
ggagagcaatctgagaagcga

SEQ ID NO: 194111 - DNA, 20 bp, Artificial Sequence
  Antisense oligonucleotide
gcctctcaacgtcagagcct

SEQ ID NO: 194112 - DNA, 20 bp, Artificial Sequence
  Antisense oligonucleotide
tctcagtctcaatctctccc

SEQ ID NO: 194113 - DNA, 21 bp, Artificial Sequence
  Antisense oligonucleotide
gttacacgtccactcccaagg

SEQ ID NO: 194114 - DNA, 20 bp, Artificial Sequence
  Antisense oligonucleotide
gctatgcctgccaccatcct

SEQ ID NO: 194115 - DNA, 20 bp, Artificial Sequence
  Antisense oligonucleotide
tttcctcccaattcctacct

SEQ ID NO: 194116 - DNA, 20 bp, Artificial Sequence
  Antisense oligonucleotide
gaccggacacttcgccatct

SEQ ID NO: 194117 - DNA, 21 bp, Artificial Sequence
  Antisense oligonucleotide
gcagtctttctagatcctggc

SEQ ID NO: 194118 - DNA, 21 bp, Artificial Sequence
  Antisense oligonucleotide
ctccacgagtccatgacagca

SEQ ID NO: 194119 - DNA, 21 bp, Artificial Sequence
  Antisense oligonucleotide
gcgccaggcagtctttctaga

SEQ ID NO: 194120 - DNA, 21 bp, Artificial Sequence
  Antisense oligonucleotide
gtcctcttgtcttcttctgtc

SEQ ID NO: 194121 - DNA, 20 bp, Artificial Sequence
  Antisense oligonucleotide
atcccttggctcccttccct

SEQ ID NO: 194122 - DNA, 19 bp, Artificial Sequence
  Antisense oligonucleotide
aggtcagcaacattgaggg

SEQ ID NO: 194123 - DNA, 19 bp, Artificial Sequence
  Antisense oligonucleotide
tttcccagtcccagattgg

SEQ ID NO: 194124 - DNA, 21 bp, Artificial Sequence
  Antisense oligonucleotide
gtagatgccacggagaaggga

SEQ ID NO: 194125 - DNA, 20 bp, Artificial Sequence
  Antisense oligonucleotide
ccgagaggttcatgtcatca

SEQ ID NO: 194126 - DNA, 20 bp, Artificial Sequence
  Antisense oligonucleotide
gcttccactcctctcgttcc

SEQ ID NO: 194127 - DNA, 20 bp, Artificial Sequence
  Antisense oligonucleotide
tctcgagtgggtgctaggac

SEQ ID NO: 194128 - DNA, 20 bp, Artificial Sequence
  Antisense oligonucleotide
tctccacagtctccctcctt

SEQ ID NO: 194129 - DNA, 20 bp, Artificial Sequence
  Antisense oligonucleotide
cctgaagagcctgagagagc

SEQ ID NO: 194130 - DNA, 20 bp, Artificial Sequence
  Antisense oligonucleotide
cccatccctcatttcctccc

SEQ ID NO: 194131 - DNA, 20 bp, Artificial Sequence
  Antisense oligonucleotide
aggagagagtaggccagcga

SEQ ID NO: 194132 - DNA, 21 bp, Artificial Sequence
  Antisense oligonucleotide
gtatatcccatagcccaccac

SEQ ID NO: 194133 - DNA, 20 bp, Artificial Sequence
  Antisense oligonucleotide
cctggtaagtggagctggga

SEQ ID NO: 194134 - DNA, 21 bp, Artificial Sequence
  Antisense oligonucleotide
gccaggaaatcggtgagtgtt

SEQ ID NO: 194135 - DNA, 19 bp, Artificial Sequence
  Antisense oligonucleotide
gttagcagaaacaaccacc

SEQ ID NO: 194136 - DNA, 19 bp, Artificial Sequence
  Antisense oligonucleotide
agagatttcctgccaactg

SEQ ID NO: 194137 - DNA, 20 bp, Artificial Sequence
  Antisense oligonucleotide
acaaccaccaccaccaccac

SEQ ID NO: 194138 - DNA, 21 bp, Artificial Sequence
  Antisense oligonucleotide
ttcactgagcctcgtgggcaa

SEQ ID NO: 194139 - DNA, 21 bp, Artificial Sequence
  Antisense oligonucleotide
tcttcatttccctgcttgccc

SEQ ID NO: 194140 - DNA, 20 bp, Artificial Sequence
  Antisense oligonucleotide
cttcatttccctgcttgccc

SEQ ID NO: 194141 - DNA, 19 bp, Artificial Sequence
  Antisense oligonucleotide
aggtcccagtgtagttgct

SEQ ID NO: 194142 - DNA, 21 bp, Artificial Sequence
  Antisense oligonucleotide
tgggcaagctggagggaaaca

SEQ ID NO: 194143 - DNA, 20 bp, Artificial Sequence
  Antisense oligonucleotide
tcctctctctctctctgtct

SEQ ID NO: 194144 - DNA, 20 bp, Artificial Sequence
  Antisense oligonucleotide
gcctttagtgtcctggtccc

SEQ ID NO: 194145 - DNA, 21 bp, Artificial Sequence
  Antisense oligonucleotide
cccgtttgcttgtctgtgtgt

SEQ ID NO: 194146 - DNA, 20 bp, Artificial Sequence
  Antisense oligonucleotide
gttccctggcagtcccttct

SEQ ID NO: 194147 - DNA, 21 bp, Artificial Sequence
  Antisense oligonucleotide
taccagccttcttctactccc

SEQ ID NO: 194148 - DNA, 21 bp, Artificial Sequence
  Antisense oligonucleotide
gtctttcctctctctctctct

SEQ ID NO: 194149 - DNA, 21 bp, Artificial Sequence
  Antisense oligonucleotide
gcttggcaatgttcctatccc

SEQ ID NO: 194150 - DNA, 19 bp, Artificial Sequence
  Antisense oligonucleotide
agggctgtgggattgtgga

SEQ ID NO: 194151 - DNA, 20 bp, Artificial Sequence
  Antisense oligonucleotide
ctacagccagttccatctct

SEQ ID NO: 194152 - DNA, 20 bp, Artificial Sequence
  Antisense oligonucleotide
  misc_feature (7)..(7): n is a, c, g, or t
gtcttgngctcacatacctc

SEQ ID NO: 194153 - DNA, 21 bp, Artificial Sequence
  Antisense oligonucleotide
  misc_feature (10)..(10): n is a, c, g, or t
gtttacattntctccctggtg

SEQ ID NO: 194154 - DNA, 21 bp, Artificial Sequence
  Antisense oligonucleotide
gcttcctctacagatttccag

SEQ ID NO: 194155 - DNA, 19 bp, Artificial Sequence
  Antisense oligonucleotide
atgccagacccatcacttt

SEQ ID NO: 194156 - DNA, 20 bp, Artificial Sequence
  Antisense oligonucleotide
accaagggagccaggactct

SEQ ID NO: 194157 - DNA, 20 bp, Artificial Sequence
  Antisense oligonucleotide
gctcccttccctgtccttct

SEQ ID NO: 194158 - DNA, 20 bp, Artificial Sequence
  Antisense oligonucleotide
ctgctcccttccctgtcctt

SEQ ID NO: 194159 - DNA, 20 bp, Artificial Sequence
  Antisense oligonucleotide
atctccgcctcctgggttca

SEQ ID NO: 194160 - DNA, 21 bp, Artificial Sequence
  Antisense oligonucleotide
atctccgcctcctgggttcaa

SEQ ID NO: 194161 - DNA, 20 bp, Artificial Sequence
  Antisense oligonucleotide
actacgggctgctctactgc

SEQ ID NO: 194162 - DNA, 19 bp, Artificial Sequence
  Antisense oligonucleotide
actttccctccactcatca

SEQ ID NO: 194163 - DNA, 21 bp, Artificial Sequence
  Antisense oligonucleotide
  misc_feature (8)..(8): n is a, c, g, or t
tcctcccngctgcgtgtcaaa

SEQ ID NO: 194164 - DNA, 19 bp, Artificial Sequence
  Antisense oligonucleotide
agcatttctgtcagtccct

SEQ ID NO: 194165 - DNA, 21 bp, Artificial Sequence
  Antisense oligonucleotide
accacagatacagcagagccc

SEQ ID NO: 194166 - DNA, 21 bp, Artificial Sequence
  Antisense oligonucleotide
accacacagacagcagagcct

SEQ ID NO: 194167 - RNA, 27 nt, Artificial Sequence
  Antisense oligonucleotide
cuaacaucucuucagcauuuaguucuu

SEQ ID NO: 194168 - RNA, 27 nt, Artificial Sequence
  Antisense oligonucleotide
uuggaggagcuguugccugcucuccau

SEQ ID NO: 194169 - RNA, 27 nt, Artificial Sequence
  Antisense oligonucleotide
gagagaugccacucgucugaucagcaa

SEQ ID NO: 194170 - RNA, 25 nt, Artificial Sequence
  Reverse complement of the antisense oligonucleotide
gaacuaaaugcugaagagauguuag

SEQ ID NO: 194171 - RNA, 25 nt, Artificial Sequence
  Reverse complement of the antisense oligonucleotide
ggagagcaggcaacagcuccuccaa

SEQ ID NO: 194172 - DNA, 25 bp, Artificial Sequence
  Reverse complement of the antisense oligonucleotide
gcugaucagacgaguggcaucuctc

SEQ ID NO: 194173 - DNA, 21 bp, Artificial Sequence
  Antisense oligonucleotide
gtccagcagtttgagaccagt

SEQ ID NO: 194174 - DNA, 19 bp, Artificial Sequence
  Antisense oligonucleotide
tctgttcctcttagcttag

SEQ ID NO: 194175 - DNA, 20 bp, Artificial Sequence
  Antisense oligonucleotide
ccagtcagggcaacacagca

SEQ ID NO: 194176 - DNA, 19 bp, Artificial Sequence
  Antisense oligonucleotide
gctcatgcctgtaatccca

SEQ ID NO: 194177 - DNA, 21 bp, Artificial Sequence
  Antisense oligonucleotide
ccctctccttatctctttgtc

SEQ ID NO: 194178 - DNA, 20 bp, Artificial Sequence
  Antisense oligonucleotide
gtcttgtcttcttgctttgg

SEQ ID NO: 194179 - DNA, 21 bp, Artificial Sequence
  Antisense oligonucleotide
cttctctgctctgtgtctctc

SEQ ID NO: 194180 - DNA, 19 bp, Artificial Sequence
  Antisense oligonucleotide
ccctctcaccctcctttgt

SEQ ID NO: 194181 - DNA, 21 bp, Artificial Sequence
  Antisense oligonucleotide
acaaacccacccacatacaca

SEQ ID NO: 194182 - DNA, 21 bp, Artificial Sequence
  Antisense oligonucleotide
gcagtgtgtttgagggatttc

SEQ ID NO: 194183 - DNA, 19 bp, Artificial Sequence
  Antisense oligonucleotide
ggatgtgtgctgggtctca

SEQ ID NO: 194184 - DNA, 20 bp, Artificial Sequence
  Antisense oligonucleotide
gcatccatttaccgtccagt

SEQ ID NO: 194185 - DNA, 20 bp, Artificial Sequence
  Antisense oligonucleotide
tctgtcccatgcctctccgt

SEQ ID NO: 194186 - DNA, 20 bp, Artificial Sequence
  Antisense oligonucleotide
gacgcaccttcactctccca

SEQ ID NO: 194187 - DNA, 20 bp, Artificial Sequence
  Antisense oligonucleotide
attcccagttaccgccctcc

SEQ ID NO: 194188 - DNA, 20 bp, Artificial Sequence
  Antisense oligonucleotide
gacgcaccttcactctccca

SEQ ID NO: 194189 - DNA, 20 bp, Artificial Sequence
  Antisense oligonucleotide
attcccagttaccgccctcc

SEQ ID NO: 194190 - DNA, 20 bp, Artificial Sequence
  Antisense oligonucleotide
agtccctgctgtctggctga

SEQ ID NO: 194191 - DNA, 20 bp, Artificial Sequence
  Antisense oligonucleotide
acatcctccaccgccactct

SEQ ID NO: 194192 - DNA, 20 bp, Artificial Sequence
  Antisense oligonucleotide
gccaggagtcagggtatgca

SEQ ID NO: 194193 - DNA, 20 bp, Artificial Sequence
  Antisense oligonucleotide
acgagtacccaccacaccca

SEQ ID NO: 194194 - DNA, 20 bp, Artificial Sequence
  Antisense oligonucleotide
ttcctcctgtctgctccctc

SEQ ID NO: 194195 - DNA, 20 bp, Artificial Sequence
  Antisense oligonucleotide
cctatctacctcccagtcca

SEQ ID NO: 194196 - DNA, 20 bp, Artificial Sequence
  Antisense oligonucleotide
gctcatcccagtgcccattg

SEQ ID NO: 194197 - DNA, 20 bp, Artificial Sequence
  Antisense oligonucleotide
tctggccacctctgcttgtc

SEQ ID NO: 194198 - DNA, 20 bp, Artificial Sequence
  Antisense oligonucleotide
gtcggtgatgttcgggagtc

SEQ ID NO: 194199 - DNA, 20 bp, Artificial Sequence
  Antisense oligonucleotide
cccttctctccaactctccc

SEQ ID NO: 194200 - DNA, 19 bp, Artificial Sequence
  Antisense oligonucleotide
cagatccacagtccgcttt

SEQ ID NO: 194201 - DNA, 20 bp, Artificial Sequence
  Antisense oligonucleotide
gagcgcccagttgcaatgct

SEQ ID NO: 194202 - DNA, 20 bp, Artificial Sequence
  Antisense oligonucleotide
tcttccggtgccagggctta

SEQ ID NO: 194203 - DNA, 21 bp, Artificial Sequence
  Antisense oligonucleotide
cctgtgcctgtagtcccatct

SEQ ID NO: 194204 - DNA, 20 bp, Artificial Sequence
  Antisense oligonucleotide
aggctacctggcttctgagc

SEQ ID NO: 194205 - DNA, 20 bp, Artificial Sequence
  Antisense oligonucleotide
tacctcctgctctctcaccc

SEQ ID NO: 194206 - RNA, 28 nt, Artificial Sequence
  Synthetic polynucleotide
uugcccaucggggccacggauaccugcu

SEQ ID NO: 194207 - RNA, 26 nt, Artificial Sequence
  Synthetic polynucleotide
uugcgcaucgaggccacauaccugcu

SEQ ID NO: 194208 - RNA, 28 nt, Artificial Sequence
  Synthetic polynucleotide
agcagguauccguggccccgaugggcaa

SEQ ID NO: 194209 - RNA, 27 nt, Artificial Sequence
  Synthetic polynucleotide
uugcugcugaucguuugguguguguga

SEQ ID NO: 194210 - RNA, 27 nt, Artificial Sequence
  Synthetic polynucleotide
gucugauaguguguuugcuaguguuug

SEQ ID NO: 194211 - DNA, 91 bp, Artificial Sequence
  Synthetic polynucleotide
cccgggttcacgccattctcctgcctcagcctcacgagtagctgggactacaggcgcccgacaccactcccggctaattttttgtattttt

SEQ ID NO: 194212 - DNA, 45 bp, Artificial Sequence
  Synthetic polynucleotide
gttgaatccgccgccataagcagacgttggagtggtgtgaggact

SEQ ID NO: 194213 - DNA, 19 bp, Artificial Sequence
  Synthetic polynucleotide
gtttgctcgctagtcaaat

SEQ ID NO: 194214 - DNA, 19 bp, Artificial Sequence
  Synthetic polynucleotide
tcttggtgatgtactgctc

SEQ ID NO: 194215 - DNA, 20 bp, Artificial Sequence
  Synthetic polynucleotide
cagtgccctggccgcgcgac

SEQ ID NO: 194216 - DNA, 20 bp, Artificial Sequence
  Synthetic polynucleotide
cgcagacagaagctcccgcc

SEQ ID NO: 194217 - DNA, 22 bp, Artificial Sequence
  Synthetic polynucleotide
gtgtaacacgtctatacgccca

SEQ ID NO: 194218 - DNA, 15 bp, Artificial Sequence
  Synthetic polynucleotide
cactgcattttagca

SEQ ID NO: 194219 - DNA, 14 bp, Artificial Sequence
  Synthetic polynucleotide
aagtcagtatggag

SEQ ID NO: 194220 - DNA, 15 bp, Artificial Sequence
  Synthetic polynucleotide
aggggctggggctgg

SEQ ID NO: 194221 - DNA, 16 bp, Artificial Sequence
  Synthetic polynucleotide
atagacacacaaagca

SEQ ID NO: 194222 - DNA, 12 bp, Artificial Sequence
  Synthetic polynucleotide
aaagcccgccaa

SEQ ID NO: 194223 - DNA, 17 bp, Artificial Sequence
  Synthetic polynucleotide
gctaaatgcacacaggg

SEQ ID NO: 194224 - DNA, 17 bp, Artificial Sequence
  Synthetic polynucleotide
cagtgcagaggtttttt

SEQ ID NO: 194225 - DNA, 20 bp, Artificial Sequence
  Synthetic polynucleotide
tgcaataactcacaaaacca

SEQ ID NO: 194226 - DNA, 24 bp, Artificial Sequence
  Synthetic polynucleotide
acccacccatccatccacccaccc

SEQ ID NO: 194227 - DNA, 58 bp, Artificial Sequence; identical to SEQ ID NO: 193094
  Synthetic polynucleotide

SEQ ID NO: 194228 - DNA, 58 bp, Artificial Sequence; identical to SEQ ID NO: 193095
  Synthetic polynucleotide

SEQ ID NO: 194229 - DNA, 20 bp, Artificial Sequence
  Synthetic polynucleotide
atgcaaaaacattaagttgg

SEQ ID NO: 194230 - RNA, 21 nt, Artificial Sequence
  Synthetic polynucleotide
uucagcaccacggacagcgcc

SEQ ID NO: 194231 - RNA, 21 nt, Artificial Sequence
  Synthetic polynucleotide
aagucguggugccugucgcgg

SEQ ID NO: 194232 - DNA, 21 bp, Artificial Sequence
  synthetic oligonucleotide: RNA molecules with T's at positions 20 and 21
agaacucagccaaguguaatt

SEQ ID NO: 194233 - DNA, 21 bp, Artificial Sequence
  synthetic oligonucleotide: RNA molecules with T's at positions 20 and 21
uuacacuuggcugaguucutt

SEQ ID NO: 194234 - DNA, 26 bp, Artificial Sequence
  synthetic oligonucleotide: RNA molecules with T's at positions 25 and 26
agaacucagccaaguguaaaagcctt

SEQ ID NO: 194235 - DNA, 26 bp, Artificial Sequence
  synthetic oligonucleotide: RNA molecules with T's at positions 25 and 26
ggcuuuuacacuuggcugaguucutt

SEQ ID NO: 194236 - DNA, 21 bp, Artificial Sequence
  synthetic oligonucleotide: RNA molecules with T's at positions 20 and 21
aaccgugcaggucccauaatt

SEQ ID NO: 194237 - DNA, 21 bp, Artificial Sequence
  synthetic oligonucleotide: RNA molecules with T's at positions 20 and 21
uuaugggaccugcacgguutt

SEQ ID NO: 194238 - DNA, 21 bp, Artificial Sequence
  synthetic oligonucleotide: RNA molecules with T's at positions 20 and 21
aaccgugcagguccuuauctt

SEQ ID NO: 194239 - DNA, 21 bp, Artificial Sequence
  synthetic oligonucleotide: RNA molecules with T's at positions 20 and 21
gauaaggaccugcacgguutt

SEQ ID NO: 194240 - DNA, 21 bp, Artificial Sequence
  synthetic oligonucleotide: RNA molecules with T's at positions 20 and 21
cguaaugcaggucccauaatt

SEQ ID NO: 194241 - DNA, 21 bp, Artificial Sequence
  synthetic oligonucleotide: RNA molecules with T's at positions 20 and 21
uuaugggaccugcauuacgtt

SEQ ID NO: 194242 - DNA, 26 bp, Artificial Sequence
  synthetic oligonucleotide: RNA molecules with T's at positions 25 and 26
aaccgugcaggucccauaacccactt

SEQ ID NO: 194243 - DNA, 26 bp, Artificial Sequence
  synthetic oligonucleotide: RNA molecules with T's at positions 25 and 26
guggguuaugggaccugcacgguutt

SEQ ID NO: 194244 - DNA, 16 bp, Artificial Sequence
  synthetic oligonucleotide: RNA molecules with T's at positions 15 and 16
ugcaggucccauaatt

SEQ ID NO: 194245 - DNA, 16 bp, Artificial Sequence
  synthetic oligonucleotide: RNA molecules with T's at positions 15 and 16
uuaugggaccugcatt

SEQ ID NO: 194246 - RNA, 25 nt, Artificial Sequence
  synthetic oligonucleotide
gcgguacggggggcggugccuccgg

SEQ ID NO: 194247 - RNA, 25 nt, Artificial Sequence
  synthetic oligonucleotide
ggaggcaccgccccccguaccgcug

SEQ ID NO: 194248 - DNA, 21 bp, Artificial Sequence
  synthetic oligonucleotide: RNA molecules with T's at positions 20 and 21
cuagcaacuccaggcuagatt

SEQ ID NO: 194249 - DNA, 21 bp, Artificial Sequence
  synthetic oligonucleotide: RNA molecules with T's at positions 20 and 21
ucuagccuggaguugcuagtt

SEQ ID NO: 194250 - DNA, 21 bp, Artificial Sequence
  synthetic oligonucleotide: RNA molecules with T's at positions 20 and 21
ugaacccucagccaaucagtt

SEQ ID NO: 194251 - DNA, 21 bp, Artificial Sequence
  synthetic oligonucleotide: RNA molecules with T's at positions 20 and 21
cugauuggcugaggguucatt

SEQ ID NO: 194252 - DNA, 21 bp, Artificial Sequence
  synthetic oligonucleotide: RNA molecules with T's at positions 20 and 21
ucagcgguacggggggcggtt

SEQ ID NO: 194253 - DNA, 21 bp, Artificial Sequence
  synthetic oligonucleotide: RNA molecules with T's at positions 20 and 21
ccgccccccguaccgcugatt

SEQ ID NO: 194254 - DNA, 21 bp, Artificial Sequence
  synthetic oligonucleotide: RNA molecules with T's at positions 20 and 21
ccaacucauucuccaaguatt

SEQ ID NO: 194255 - DNA, 21 bp, Artificial Sequence
  synthetic oligonucleotide: RNA molecules with T's at positions 20 and 21
uacuuggagaaugaguuggtt

SEQ ID NO: 194256 - DNA, 21 bp, Artificial Sequence
  synthetic oligonucleotide: RNA molecules with T's at positions 20 and 21
ccaacucauucucccguuctt

SEQ ID NO: 194257 - DNA, 21 bp, Artificial Sequence
  synthetic oligonucleotide: RNA molecules with T's at positions 20 and 21
gaacgggagaaugaguuggtt

SEQ ID NO: 194258 - DNA, 21 bp, Artificial Sequence
  synthetic oligonucleotide: RNA molecules with T's at positions 20 and 21
uguggucauucuccaaguatt

SEQ ID NO: 194259 - DNA, 21 bp, Artificial Sequence
  synthetic oligonucleotide: RNA molecules with T's at positions 20 and 21
uacuuggagaaugaccacatt

SEQ ID NO: 194260 - DNA, 21 bp, Artificial Sequence
  synthetic oligonucleotide: RNA molecules with T's at positions 20 and 21
ccaacuuuccauccaaguatt

SEQ ID NO: 194261 - DNA, 21 bp, Artificial Sequence
  synthetic oligonucleotide: RNA molecules with T's at positions 20 and 21
uacuuggauggaaaguuggtt

SEQ ID NO: 194262 - DNA, 21 bp, Artificial Sequence
  synthetic oligonucleotide: RNA molecules with T's at positions 20 and 21
gcaacuccagucccaaauatt

SEQ ID NO: 194263 - DNA, 21 bp, Artificial Sequence
  synthetic oligonucleotide: RNA molecules with T's at positions 20 and 21
uauuugggacuggaguugctt

SEQ ID NO: 194264 - DNA, 21 bp, Artificial Sequence
  synthetic oligonucleotide: RNA molecules with T's at positions 20 and 21
acuuacgagugacaguagatt

SEQ ID NO: 194265 - DNA, 21 bp, Artificial Sequence
  synthetic oligonucleotide: RNA molecules with T's at positions 20 and 21
ucuacugucacucguaagutt

SEQ ID NO: 194266 - DNA, 21 bp, Artificial Sequence
  synthetic oligonucleotide: RNA molecules with T's at positions 20 and 21
acuacugagugacaguagatt

SEQ ID NO: 194267 - DNA, 21 bp, Artificial Sequence
  synthetic oligonucleotide: RNA molecules with T's at positions 20 and 21
ucuacugucacucaguagutt

SEQ ID NO: 194268 - RNA, 19 nt, artificial
  antigene RNA polynucleotide oligomer
ugggcuuggccugccuugc

SEQ ID NO: 194269 - RNA, 19 nt, artificial
  antigene RNA polynucleotide oligomer
gggcccuuuaacucccaag

SEQ ID NO: 194270 - RNA, 19 nt, artificial
  antigene RNA polynucleotide oligomer
cccccucucaguggcgucg

SEQ ID NO: 194271 - RNA, 19 nt, artificial
  antigene RNA polynucleotide oligomer
ggcguuguuagaaagcugu

SEQ ID NO: 194272 - RNA, 19 nt, artificial
  antigene RNA polynucleotide oligomer
aggaggcguuguuagaaag

SEQ ID NO: 194273 - RNA, 19 nt, artificial
  antigene RNA polynucleotide oligomer
agaggaggaggcguuguua

SEQ ID NO: 194274 - RNA, 19 nt, artificial
  antigene RNA polynucleotide oligomer
gcuaaaaguuuugagcuuc

SEQ ID NO: 194275 - RNA, 19 nt, artificial
  antigene RNA polynucleotide oligomer
aaaguuuugagcuucucaa

SEQ ID NO: 194276 - RNA, 19 nt, artificial
  antigene RNA polynucleotide oligomer
aguuuugagcuucucaaaa

SEQ ID NO: 194277 - RNA, 19 nt, artificial
  antigene RNA polynucleotide oligomer
cgcgacugcgcucaguucu

SEQ ID NO: 194278 - RNA, 19 nt, artificial
  antigene RNA polynucleotide oligomer
acugcgcucaguucucucc

SEQ ID NO: 194279 - RNA, 19 nt, artificial
  antigene RNA polynucleotide oligomer
ugcgcucaguucucuccuc

SEQ ID NO: 194280 - RNA, 19 nt, artificial
  antigene RNA polynucleotide oligomer
ugacucugcacccuccucc

SEQ ID NO: 194281 - RNA, 19 nt, artificial
  antigene RNA polynucleotide oligomer
ucugcacccuccuccccaa

SEQ ID NO: 194282 - RNA, 19 nt, artificial
  antigene RNA polynucleotide oligomer
ugcacccuccuccccaacu

SEQ ID NO: 194283 - RNA, 19 nt, artificial
  antigene RNA polynucleotide oligomer
auuacuugcccuuacuugu

SEQ ID NO: 194284 - RNA, 19 nt, artificial
  antigene RNA polynucleotide oligomer
cuugcccuuacuugucaug

SEQ ID NO: 194285 - RNA, 19 nt, artificial
  antigene RNA polynucleotide oligomer
ugcccuuacuugucauggc

SEQ ID NO: 194286 - DNA, 21 bp, Artificial Sequence
  Synthetic primer
  misc_feature (1)..(21): This is combined DNA/RNA sequence.
ugucuggccaguccacagctt

SEQ ID NO: 194287 - DNA, 21 bp, Artificial Sequence
  Synthetic primer
  misc_feature (1)..(21): This is combined DNA/RNA sequence.
gcugucuggccaguccacatt

SEQ ID NO: 194288 - DNA, 21 bp, Artificial Sequence
  Synthetic primer
  misc_feature (1)..(21): This is combined DNA/RNA sequence.
aguugugcugcccuuccautt

SEQ ID NO: 194289 - DNA, 21 bp, Artificial Sequence
  Synthetic primer
  misc_feature (1)..(21): This is combined DNA/RNA sequence.
cauaauccugaccaaaacatt

SEQ ID NO: 194290 - DNA, 22 bp, Artificial Sequence
  Synthetic primer
  misc_feature (1)..(22): This is combined DNA/RNA sequence.
uguauugagguuuuagaugctt

SEQ ID NO: 194291 - DNA, 21 bp, Artificial Sequence
  Synthetic primer
  misc_feature (1)..(21): This is combined DNA/RNA sequence.
ccuaguaaugaaaccaaugtt

SEQ ID NO: 194292 - DNA, 22 bp, Artificial Sequence
  Synthetic primer
  misc_feature (1)..(22): This is combined DNA/RNA sequence.
guauauuucuagagcuauactt

SEQ ID NO: 194293 - DNA, 21 bp, Artificial Sequence
  Synthetic primer
  misc_feature (1)..(21): This is combined DNA/RNA sequence.
guuugccugcaucaguucctt

SEQ ID NO: 194294 - DNA, 24 bp, Artificial Sequence
  Synthetic primer
  misc_feature (1)..(24): This is combined DNA/RNA sequence.
aaccagcaccccaacuuuggactt

SEQ ID NO: 194295 - DNA, 24 bp, Artificial Sequence
  Synthetic primer
  misc_feature (1)..(24): This is combined DNA/RNA sequence.
aacuggcccucaaagucccgcutt

SEQ ID NO: 194296 - DNA, 26 bp, Artificial Sequence
  Synthetic primer
  misc_feature (1)..(26): This is combined DNA/RNA sequence.
uugcagcugccugggagugacuuctt

SEQ ID NO: 194297 - DNA, 24 bp, Artificial Sequence
  Synthetic primer
  misc_feature (1)..(24): This is combined DNA/RNA sequence.
ugcuggaucagugguucgaguctt

SEQ ID NO: 194298 - DNA, 24 bp, Artificial Sequence
  Synthetic primer
  misc_feature (1)..(24): This is combined DNA/RNA sequence.
caggauguggucaaguguuguutt

SEQ ID NO: 194299 - DNA, 23 bp, Artificial Sequence
  Synthetic primer
  misc_feature (1)..(23): This is combined DNA/RNA sequence.
uacaucagcuacuuuggcauutt

SEQ ID NO: 194300 - DNA, 21 bp, Artificial Sequence
  Synthetic primer
  misc_feature (1)..(21): This is combined DNA/RNA sequence.
aaaggcucugagaaagucgtt

SEQ ID NO: 194301 - DNA, 21 bp, Artificial Sequence
  Synthetic primer
  misc_feature (1)..(21): This is combined DNA/RNA sequence.
uuuguuuuggcagcaacagtt

SEQ ID NO: 194302 - DNA, 21 bp, Artificial Sequence
  Synthetic primer
  misc_feature (1)..(21): This is combined DNA/RNA sequence.
caucuguggauuaagcaugtt

SEQ ID NO: 194303 - DNA, 22 bp, Artificial Sequence
  Synthetic primer
  misc_feature (1)..(22): This is combined DNA/RNA sequence.
cuccauuuucucuaucuucctt

SEQ ID NO: 194304 - DNA, 21 bp, Artificial Sequence
  Synthetic primer
  misc_feature (1)..(21): This is combined DNA/RNA sequence.
guggaaaagugggaggacatt

SEQ ID NO: 194305 - DNA, 21 bp, Artificial Sequence
  Synthetic primer
  misc_feature (1)..(21): This is combined DNA/RNA sequence.
uguugaugauucugguugctt

SEQ ID NO: 194306 - DNA, 413 bp, Homo sapiens
gggagccccaggtggcacagaagcaggctgagtcctattccttgggctgggaccccagtagagccgagtactgaggagcctcattcaaaacacaggatcccagggccgggcgcagtggctcacacctgtaatcccagcactttgggaggccgaggtggtcaccgaatcacgaggtcaggagattgagaccatcctggctaacaaggtgaaaccccgtctctactaaaaatacaaaaaattagctgggcgagctggtgggtgcctgtagtcccagctacttgggaggctgaggcaggagaatggtgtgaacccgggaggcggagcttgcagtgagccaagattgtgccactgcactccagcctgggcgacaaagcaagactctttctcaagaaaaaaaaaaaaaaaaacatgtc

SEQ ID NO: 194307 - DNA, 413 bp, Homo sapiens
ttttttttttttttttttgggcaaagactaagagtttataattggagcgcactcattcattcattcattcaacagtgtgtagggcccctgatctcttccaggcactggcccaggccctcccatagggagttctcaggatggagtgaggggcactgatgagacctcccaccgaggaggctgggggctatgatggggcagacagaaatggccacgtcagctcctgtgggcagttggggacaggtaggaacaggtgtggcaggcaggggtggcatgagtgcaggcaagaggcaggggcgcagtgagctggggagcagctgggggtgagtgagctggaggagggctgcgtggtgggggctgcagccatcagtccccacctggaggcggcccaaagggagcctggccctggtctggtg

SEQ ID NO: 194308 - DNA, 334 bp, Homo sapiens
cagtagttctccagctggtagagggagcagatgctggtacagcattgttccacaatgccacgcttctgcagggacccctccagggccaagggctgcaggctgcctgcaccagggcccccgcccagctccacctgccccacctgcaggacctctgcctttctcgtttcttgggagtgtagagaagcctcgtccccgcacctaggtagagagcttccaccaggtgtgagccgcacaggtgttggttcacaaaggctgcggctgggtcaggtccccagagggccagcagcgccagcaggggcaggaggcgcatccacagggccatggcagaaggaca

SEQ ID NO: 194309 - DNA, 582 bp, Homo sapiens
gcacgagttttttttttgctggttcaagggctttattccatctctctcggtgcaggaggcggcgggtgtgggctgcctgcgggctgcgtctagttgcagtagttctccagctggtagagggagcagatgctggtacagcattgttccacaatgccacgcttctgcagggacccctccagggccaagggctgcaggctgcctgcaccagggcccccgcccagctccacctgccccacctgcaggtcctctgcctcccggcgggtcttgggtgtgtagaagctcgtgccgaattcggcacgagcaaaggtgttccacggaaacacagacatgttttctatcccaccttttctttttaaaatgaagtatttttgataaagtgaattttaaaacacaaaatagcaatccccaaagcacaagctaacaatagtaattataatcataattggcacttgtatataatgtcattttgcagggggttcagccattttcacaggcatcacctagtctcagcagacacgtttgagtttcctaggtcgtaaatctcattgtctgtattctaaggatataaaatatgaaagtgaa

SEQ ID NO: 194310 - DNA, 416 bp, Homo sapiens
gacctcagcagtccctgctgaggaagctgccgggctccctgtgtaccactggccttcatgaacaaagctgacaccatcatgctccttcggacatattctgctagcataaagggacccccatctccccaaccgaattaggcagagctggccttccttctagcggagttcctaggagtgagttggtgccaccccttgtgaggcttgatccaaaaaccagaacctctccagaccagggatccatgtcctctaacacaagaggggcagacctaacctctaaaatccctcccactctaaccttcagcatccacagctcaaaacaaccaggatgcctcagaaacagcactcactggggcgagcaggattaggcttcagaaaaaccaggtagatccagtttcttctgtcagaaaatgtttttt

SEQ ID NO: 194311 - DNA, 3591 bp, Homo sapiens
agcggagtgattctcctgcctcagcctcctgagtagctgggattacaggcgccagccaccatgcccggctagtttttgtgtttttagtagagacgggatttcaccatgttgcccaggctggtctcaaactcctgatctcaggctcaagctaccttcttgatgaaaaattctggacgtgttctgaaaatcacagtcatccctaacttcagtggaaaagattcatattgtccagctgaacaaggattgatacttaaaaccagggatttcctaaaatgaaaatgtttctgtggataaaactgattacatgcagagactggaatggagttaattctgggtagatatgggattcaagagattggtcttcatgaggcatttatcaaggatctgcaagggatttagaggtgacggaagcacagtccttcctgggcagttgcctctagcctggtgggaggtgttcctcacacccaggactctcatccatggcaaaataaaaagtgagatatcgactgggcatggtggctcacgcctgtaatcccagcactttgggaggtcgaggcgggtggatcacctaggccaggagttcgagaccagcctggccaacatgacgaaaccccatttctactaaaaatacaaaaattagccatgtgtggtggaatgcacctgaagtctcagctactcgggaggctgaggcacaataattgcttggacccaggagaaggaggctgcagtgagccgaggtcgtgtcactgtactccagcctgggtgacagagtgagactccatctcaaaaaaaaaaaaaaagtggatatcacatcagagaagctcctggccaggtggccttgaggaacagggatgagttcagcacttagagatggagttggctttccccgttggagggaaaggcatgagaagggacataggtaagaggaagtagagtagtgcaggggccattgagtagtagtccttccaagacaggacttcatcatagaaccactttctctgaggaagctctgcttgggggaggttttaattcatgaggaaggcaaattcaatggctctcaggtgaggtgggaaacagacacctaccaacactccaaagagaacatgtacctctataaaagggcacagtctagtgaacaaagtccacagctctgggtttgatttctagcactgtcacttaatactgtgtgaccttagacattcacttaactctctcagcctcaggatacaatctgtaaaaacaggagaatgcttgttccctgtgccttataggattgatatgagcatcaggagagacagtgggcacaaaatagcactgtcaactacttctttctagtcagttatctggtcatgtttgtgaagctccccaggactgggaacatagcatatgatttttttaaagttacttgatgaatgaatgaataaatgaatgagtaaatgaatgaataatatctaaaggcctccaactaaataataatcaacttcctaaccgtactgaaagcctttaattgactttggggctgtttggcctggaggaggctctgagttagtggtgatcagttggtgtcatggtagagaagaaagcctgtgaaggtggagtcattgtcattatcagcatagagtccattacgctctccttccccatacacctggagccagacttggtcgcccacctccagatgcaggagcacagagccggaggcctggtccacattattttcctggtactgatcataggtgaagagcatagccttgtccttcttgaagaggctgaccttcacatccttcatatagactgtgatgtggtaggcaaagtagtacagcccaggaatgttgcagtggaatttaccagtggagccatcatagtggttttgctgattgtagaagatcttggtaaagcgaatgggcatgttggggatagtaacgtaagtctccaatcccacactgaatgctgagcggtatacataggcaccttctccaggttctcctttcctgccttggattcccggaaagcctcggggaccttcagccccgggtactccggtttcaccgatgtctcccttaggaccaataagacctaaggaatgagaagacctcagtgactacaaagaacagaactcctgcctaggatgtctctcctcctctattctgcctacccatcattcaaggcctagctgaagctctgcctcctccttgaagccttcattcttcatcaggtccacggggtgccatctctgccatcacggcctggggccccattatggcccggatgccctgggatgcccgccatccaacctgtgcaggcccccttgggcaggggaagcaggactccgggcccttgagtcgtggtttcctggtcatgaccgggcagagctaatagcagtagaacagctcccagcaacagcatcctgagccctggaatccacatgtgcactgtcagccatggagagacagaccccacacacacacccagttgggacctacaaaggactccgtccatctcagcagagtctacttctaggagctgctttctaagtattcaacttttccaggaagacttttctgaatattgcagcccaccttgatctctttctgccctgaaatctgtaatacttagcattattccctgtgtgtagtctcctttcctcaccaagattatgaattcagtgattgcacagatgacactcctctaattttcccatgtctgagcacaggaccaagcacagggaaagctccaagagtcgacttgccaagaatccatccttgggtttcccaagtacgatgacacagattgctccattcaatgctaaccagcttctctcctctggctcctttcttctttttctttccccccttctctctcattttctgtgtctattcctccttcttactctctcattctctttcttcctctacccctctcctggggcacatgtttgactattgggtatattacatttgcacacatgcacacacacaaacacacacagagaaaaagagagagagagggagggagagactcaccttgtgttaagcagacaacgagagacacatcatcccatgaacatatcccctggccctttgtttgcctgagccatctttagctgcccctcctcccctgtctaatctctattcagccttcaggacccagtttggatgtcatctgtttcaagaagtcctccttgttctccatctcactccttggctggttctttcccctctgtgtttctccagtgccctggtaatatggtttgggtctgtgtccccacccaaatagcacgtcgacatgtgttggagaaggggcctggtaggaggtgactgaatcatggaggcagacttatcccttgctgttctcatgatagtaggtgaattctcacaagatctggttgaaagtgtgtagcacttcccctatattctctctctctctctttctctctctctctcctgctgctgtgtgatgtgcttgcttccccttcgctctttcttccaccatgattgtaagttttctgaggcctccccagccatgcttcctgtacagcctgtggaactgtgagtcaattaaacctcttttctttataaaaaaaaaaaaaaa

SEQ ID NO: 194312 - DNA, 875 bp, Homo sapiens
attttgctttccctgcctaacgcagccatggcgcgtggtcccaagaagcatctgaagtgggcagcagctccaaagcattggatgctggataaattgaccggtgtgtttgctcctcgtccatccactagtccccacaagttgagagagtgtctccccatcatattcctaaggaacagacttaagtaagccctgacaggagatgaagtaaagaagattacatgcagaggttcattaagatcgatggcaaggtccgaactcatataacctaccctgctggattcatggatgtcatcagcattgacaagacgggggagaatttccgtctcatctatgacaccaagggtcgctttgctgtacatcctattacacctgaggaggccaaatacaaagtgagaaaaatctctgggggcacaaaaggaatccctcatctggtgactcatgatgcccggcaccatccgctaccctgattccctcatcaaggtgaatgataccattcagacagatttggagattggcaagattaccaatttcatcaagtttgacaatggtaacctatgcatggtgactgtaggtgctaacctgggaagaactggtgtgataaccaacagagagaggcactctggatcttttgatgtggttcacatgaaagatgccaatggaaacagctttgccactcaactttccaacatttttgttattggcaagggcaacaaaccacagacttctcttccctgaggaaaagggtatctgcctcaccattgctgaaaagaaagacaaaagactggcgaccaaacagagcagtgggtgaaatggtccctgggtgacatgttagatctttgtacgtaattaaaaataatgtagcatgataaacagaa

SEQ ID NO: 194313 - DNA, 194 bp, Homo sapiens
aaaatcaacagtgcaagaatatggccagggacaatggctcctgcctgttaaatccagctattcaagaggctgagggaggaggatcgctcgaggccaggagttcaagaccagcctggacaacatggcaaaaccctgtttctacaaaaaatacaaacattagccaggcatggtggtgcatgcctgtaatcccggct

SEQ ID NO: 194314 - DNA, 2074 bp, Homo sapiens
acttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaacgctaaaaaaaaaaaaaaaaaaaaaaaaaaaaaaaa

SEQ ID NO: 194315 - DNA, 1237 bp, Homo sapiens
gagaggtgctacgggcgagcgcgagcccccgagggcggctggaagccccggactgttggtagagtggaaggggatagagatcggtggggcgagcgtcctccgtggccagtcctcccctcaccgcccttcctcaggtatcgggaagagttgccagcggccatcaggggcagagcagagaagcatgtgacagggagctggagcggctgctggcctggcagcttgactgtgaagggcggcccgccccgagggcagggcctccgtagcgcgggtcttcattggggcgtggcatcggcggggcgggtgtctccagtgggggcggggcctccctggtgggtccagcaccccaggcaccctgacctggcctcccacagaggggcgcttccggccacgtctgcagcagctggtggccaccaatccccctgagctggttgtgcactgttcgaccgccaccttctgcctcctgccagatgtgggggctgcagtcaccgagctgtgtgccctctgcggtgtgggcccaccacagcctcgggtgagttgggtgggcacgacttgggtacataggcgttcttgtctgtgaagcgggcagtctgggcccttgcgtgtcgctaggagcaggaaccatagggccctgggctgctgggagcagggtctcccagagcttgtcctgatggggtgtgtctggctgcttctcctcgctgttcacagcagtcctggcagctggagctccagagatggaggccttcatgtcagatgaggcggtggccacagtgcccggctggccggccccacagtacaccctcaggtactacctgctgtacctgggccaggttcaagagcgggccacagctctgagccaaggggaatgaactgtgtgtgggcaggttggggtggcccgtgcccctgggcctgagtccgtgtgcccctccctagccagtgcctcaggacagtggactccctacctagtggagacagcactgtggacctgggctgtggggcagaggctgtgcccagacctgctgcccaaccttggccccagcctggccacccacgaggatgctaggccagccaagaagcatggaacccaggccgagtaaacttggccatggcccaggcctgctcacctgccacagaacctcaggcctccgggtctcactggacggcagggaggctgaagaggaggctggccactacgggagctcaataaacacttcccaaactcaaaaaaaaaaaaaaaaaa

SEQ ID NO: 194316 - DNA, 4050 bp, Homo sapiens
gctggggcacgagtggctgcggagtgtgggtggttgggcgtgaggggccgacgggctcgcgcgcgcgccgtctgctgaggtccctcgggaaggaggagagcgcctgacgccgacccgcaggcgcagcccggcagtcggcggcgcgccgagggcggaggtggtgcgtgcgtgcgtgtgtgtgtgtgtgtgtgtgtgtgtgtgtgtgtgtgtgtggagctcgggtgccaagggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaaggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgactgtgctaaagaataatgatttaagatcgagacaagagttaactgcccatctcaccaaccagtggccttctccaggagctctggatgtcaatgctgttgccttggatacgttgctttaccgaaaacacaataaacagtggtatgagaaaagttatcaaagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaaaaaaaaaaaagttaatttcattttttcattaatgtcttcctaagttctatgctttaaatgccttgtttttaataacgggaaagttctcagctgcattttcacagtggcttattcagtttttctttaatatttaccatttggtatcaattcagcattccacttaacattttataaattccataggaacatgcctgttttggtagttactgacttaatttgttagtgccacaaggaaaatattttacagtattttatgccatttaggcaaaatgaataaactgttttccaagattttcttaaaagattatcaatttaaaagtatgatcaagtatgcctcaaaaactagaaacatttcaaaatgtagaacaaacgttgaaaaattgttttgccaggaaagagttcaagttcagttaaggatttgagaggcttttaaacaaggatcagtaggatagttatcatatttacttaatatatgtctgatattcagtgctggttctttttcctgtttgtgcaacaatgaagtgtgtcatgtgtgttttatagcctctatcattaatcacaccagagtctcattttaaaacattttaatgttaaaacatccccacacttatacacaggtaaaattagtttttttttttttaaagttgtaatctgtacttttttttttttgcaatttttgaaacagctacattaatccctaaaaatcccaccatactgaaaatgtatggcgtgtattttctatagtaagtaatatgaggaaaacatgattagctgtgccaaagaaattttatacattgtttacatgatgaggccacagtacttactgaggacttcatatggtttttttgtttattattattgagaaaagagctgaggttaccacattcattctttgtgttagaaatgtaggagtgtggtggttttctgcaatatttagagcttagtctcataatttggaatttaagataataagtagtaacaaggcaagtcttttatgtaagacagtcaaacagtgtcacttcagggacaaaggcctggaagcccttaaaataagttatcttagatgtgccagaacatattcagagctttattcctttaagcttaaggcttcaatacttgtagaaatgcaaatattcttgagaaatgatacattttttgttctcaatttctcaattctacatacctgattatgagtgaagtatccaaagcaggttttcatcagcatgggggatggaaggtaggtataatatgaggacaatggaaactttgggagaagggagtgaggaaatggataaagagaaatttgaaaattttaggctggacttgagcactattgctgctttcctatgaactatcagaatgtttaaatgctttatcattcatggtccactctcaaccaacatttattatcctttagtaattaaacaatggttttacatacatttttataatgtagaaggaaattcaagattccataatcgtaaaatttttcagatttgtctaatgtgtaatttgtgcatcttcacatgctgctaaatgcagatttaaacattacatctgaggatcatgacttttcctcctttcttggagatcttggtataaaattcatctgctgttataaaatcaggtttctacagagttcgtttcacactaaaggtagtttgttactgtttgcatgaggaaaccatgtatgtctcaatctttaattttaggtggtagtgtttattgttcaccctccctcttgcctccaaaagaatgctgaattatacgccaatatttccatgtgtattctgttgccttgatgcgtactatacttgttgcatgtatattaaaaattttgtactatgca

SEQ ID NO: 194317 - DNA, 1334 bp, Homo sapiens
gctgggtcccttccgccctggcgcgctcctccaccagcccgcggctgcgagctgggcagcgagatccacagcacagggctggcgcggaaaacaccgtcctgaaggctgctgctgcgggtgctcttggagcgacttgtggctgtcgccacttggtccccacagactcaagaggacgctaccacccggaccggactcaggcatccggagcaccgcactcttccgagaactgcctacctcacgtgccacctccgggtttccttcgcaaagtcagccaagatgtagaatttggaagtagctctgagttgagcggaacctcagaagatggaagcagcggcctcagcctcttacggcttcaagagccactgcgggaaggagccagagggcttcctcgggccccggattaaaatagatgccagcggccgccctaaggcccggcagccaatcagcctggtgggtgggattgggcatgggcagctggagcggttgcgaaacaggagatacttccaggcttaccctgatttttttgagaagggcgctggttccctcagacatttacatagacttgtctttacgtgttcagtgggcagtgtgttcacaccgggattgaagtcgctcaactgtgaaatgacatgggaacgttccagtgtgttcacaccaggattgaagtcaataaactgtgaagtgacatgggaacgttcaatggcctcacacctcggagtctcaatccttactgatttgatcccctgaatccacaggtgcaagagagagccaactcctgaaagttgtcctgtgacatccacacttgcaacatgacatagggtacatgtggatgccagaagacaaacagatgtcttttctcaggagctgtccatcttgttttctgacagttgttctttgttaactagggctcactgtgtaggcaagtctggctggccagcatctatctctctctacctcccagtactgggattataagcacccccctcataccctgactttttatgtggatgctgaggactgaatcaaattcttattcttgttgggcaagcacattaccaactgaactgaatctccccggctcctactggtacttcttaatgcatattaatgaaccaactaatgggtttcactgtagaatagatagatagatagatagatagatagatagatagatagatagatagatagattaattatacatagaaatcacacacacacacacacacacacacacttcctgcagtgtttatgctgaccatcacctctcttttcccaaccaccattcccttacctttcctccccttccaaccactaataaacccctttcttctgtt

SEQ ID NO: 194318 - DNA, 635 bp, Homo sapiens
ggtctcacggtagctgtccttgggcttcccatcccgcagcgctccgatgtgaccctcctctgcgcggaaaatttcgacccggggcgccggcatcgcgacgctcagccagtgcccgcgaggctcccaggagatgcggggtagtaaggccctaaaaagaggagcctggacacggcctggattgagaaagaagcaagcaaacaaaaatcctcggtagctgtgtgtagcttcaggagtggagagccgagacacaccgacggcgccggagcgtcgcaagaacaatggttgctgcagtgggttgggagagaggacccggacaagttcctaaaggcacgggaggaacgcgggcaaaccaggtttagggccccaggcgaattgtggaaggaatgacttcctcaacctatcagcaccgtggacaattcccactccaacggccctgaccttcggcctactagattcagcaaaaatctctcttcctcccttgcttcctcctttccttcctcccttcctcctttccttcctgccttccctccctccccttcctcctcctttccttcctttcctccctccccttcttcctcctttctttcccttcctcctttccactcttccctgtttgctttgtttcaaaaacaaaa

SEQ ID NO: 194319 - DNA, 17964 bp, Homo sapiens
ctaactatctcacaatataggtccccaaccactgaccaaactccagtccaggcagccaccagctggcctggtcttgctgcttcctttagcggcttccaaggtccagggacagggggtctgggccaccaagaggctctgctaggctgtccctgcagccacagccaccccactggacccctgcctcccatctgagaggacagccctcttcctggagctgggatctgacacttgctgataccaacggcagataccaggtaggtcccctccctttctcttccttgagctcctaaaatgccactcataccaccctctgcactcggcaaaggccactgtggcttaatcaaatcaggcacccacaaagcttcaagactggaaaagatgccttggctaacccacccatttagtggacggaaacactgaggccgtcaggggagtggcagctggccacagactgaaccatagacttggggcccagacctggggcccctcacggagcctcagagggtgaaagggacttgctcaagtccacgcagcggtggtgggtgagctttgtcttaacaacgagcactttctacttcatcacagaccatgagtggcattgtgtttgttcacccgatgatgggtggccactggcttgttcacccgatgatgggtggccactggcttgtcacaggagtatttccgagaggaagatgagggagcttggggctgaaggccagtgggtttggaaggaagcaacattcatgtggttaactgataactgggccccatccctgggcctccttcctccctccctgtccttagcctgattaagaccaacttacccagctgctaatcattgctgagcctgttgattttgccttaaaaaattaactgggcatgagtttgcggttttcctcacccctaaccctgaaaaggcctgggtgggcaggaggcctccagggttatgcaagaggccgctggcctcccaacgcatagcccacggccacctcggctgctctccaaagaagaggctttgctcaagagtcaacagtctgcttgttccccctgtgctgggtcctgagcaaatttgctctgttaccaaagagagataaaggcagctgggggagagctttccaaacagggatgggaagcggcagctttgagcttggggttctagaactctgcagtgtcagagccaggagaatctttaggaggatgtgggctggggtttttcaagctgggttccgaggctcccaggagccaagggtatgcatccacaggcccagcttcaaccagcgactcccttttacatgtagtcttaatattttatttgagggttggaaaaccactgattcagccccatcccctcattgcacagatggggagatggagatcagagggggaagtgacttgtccaaggacagaaggtcacctcgggtattcaggggctccagccagcatgggaatgaatggtgggctctctgtggacccgggcaatgtcttgaaagacattggtgaacaagacggctctgcaaacgccttgccatgccgttctccccctcctcccagggctggctggaagcagagaggtgcctgagagccattggaagacccaagtcaggggaatgcacctggctctgtgtcccatgggccctgtgaggatatgaccagcagccaggcactgcaaaccggagactacgttataatccatctcagccacgtcctgtctctggaggcatcagcactttgggaggctgagatgggaggattacttgagcccaagagtttgagaccagcctgggcaacatagtgagaccctgtgtctattttttaaaaagattttttaaaattaaagacagatgcccagtccctatcacaaaaaaagatgtagagccctgccctgactctctccacctctctgagcctcagtttcttcacctgtaaattgggaattataatacttaacttccagggttgtcatgaaaatgaaatgaagcaaaatatacacattgatcatcatggccactggatatgcagctgttttaggagctttgcatgtgttacttccttgatcctcccagccactctgggaggtaggcaatgttttcaccaattttttacacaccagaggcacagggaggttgagccatatacccatgctcacacagctgatgagaaacaagaagtggaattggaacttgggcagtctgtctctagagtctgtgcctctaactccagggctacccttcccttccagggatgccagtgagagatggccaggagaagggcagagagcagggcactgtgggagatgctgactgtaaggctccggaggtagggcagagagtatggtctggagaatgatcaggaaggaagccaggaggacttggatctgtgtgggtggagcttctccgcaggctgcctcctgccaggtggcttatgacatctgggctgagggtgttgctgtcctcctgtttatgttcatccctcctgtttatgttcctgaatttatctgcaggggtgaccttgggaattagatgcggccttcccggcccttgtggggcctgaaggctgatgggagcccctgcctgacccagactctggtttggggagtgagggctgagcccacatcccagaagccacccttggtctccccatactcttgttctgaggggccccagggatttgccaggtcactaaggtgaagtgtttggaagtcctgaggctcagatcagagttactgccctgtacagttgtgcaggttgctcactgcacaaaggttctccagccaagagggcaggtagggatggaaacccagcccttgttccacttgccaagcgaagtgcccatggagctctgcctgcccagagtggggtgcctttttcttatttgccctagggcttcatgtaagctgctgggtgtcctgccccagctctggttccagccactgtgtgtccttgggcaaggtcatttccctccctggccttggtttcccattggagaagttttgtctaacaaagcagagactcatctctgaagatgaaatagaatcatctgaaacctttaaaatatacagatgttggccgaacatggtggcttacacctataatcctagcactttgggaggctgagatgggaggtttacttgaacccaggagtttgagaccagcctgggcaacatagtgagaccctatgtctattttttaaaaagattttttaaaattaaagacagatgcccagtccctatcacagatcaatgatcgaatcttggggtaggggtggggaggtgccaggcgtctatatttttgtgcagccaatattgagacccactgtaggggggcttcaaatttgaacctggaaagccttcgatggcatcaagttctatcacttactacaacttactagtcaaaacctcagcgaggctcagttttcccatctgtaaagagggaatgatgatcgtttcctcacaaaatcaaaatgccaattaaatgagataatgttcagacagtgcttggcaccatgttccccaagtagggagctcctgattcttgctaccaagactattattgttgttatgggcaatttgacgttgacaaaataaagggcctttctaggtcaaggattcggtgacttgaagacaggcctcctctgttgctttgagtcaatttctagtacctgggcctaaatcttgactgcacaccggtcatattattgaggtatgtgttattattattatttaatattttacttaatttgtgaacatctttacatttagttttgaattggtgctacattcgcatggttcagaatcaaaacataaaaggtgtaaattgagaagtcttgcttccagctgtctcctgttcacctgttctccttgacttcctcactatggggaaccacatcccttacagatgtatctgccaaggtttctttatacagaccagatagcatgtaagatcatacatgagtagcctctgctcttacactgttctgtatcttgtttggttcatttaatatcacaacctggagatgcttccatagcagctgagagcaagctttgaggatggaagggttctcgtctcccatcacaggtgaggaaactgaggctcagagaagaaacatcattttcccagtgagccaaggcaatggtgttagaactatctctacctggctccagagcttgtgtttatgcccctgcaccgatacggccttccatgaagcccggcccagaaagctttggagtctggttacatctctgccatgcaggcctggccttcccaggacaagaggtgaggaggggggctgtcggggtcctcactgtgtctggactcagaaatcccaaagagaggatgaagtgtagaacaaagaatgtcccaagtcatccagatagggacccagtgggaaggtgtcccctggatggaatagtgggggcctggtggctgtgcccgtcagcactggagaacctgccaggaactctctgccagcctcaggtggtgcgggtggcaggggaagtcaggaggaggatgagaggcagggagggaagcatggccgatgagacaagctctgggtgaggggatggaggggaccccatgcctggagctcaggaaggaggatttggagttcaaggcagaagtggcaatgagattttaaccgattgttttctgctcagggaacttcagggttccctctggattcttgacctgcttcagtttgctgactcactggctttgggcaagtcattttccctctccgtgcctcagtttccccaactgcaaaatgagagagataagagatctggtctttaggcagccttggactacccctaatactctacggggctcctctcaccttgttgaggtcgtctggattctccttctctgattggaacgtcattcacccatcagggccatggacgttcctgggttaggggatgagggtacaaatcctccacactgctcccagtctggaatcctcccccttggttctgtgtctctctcctaccatcccatccttccttccaggcagatgtggagtcaggaccatacctggtgggtcctgggggaagccctggccccagtccgacatcctcctcctgctgctatggggtcccgcacagtgcacaacctcttcatccttgagggagctcctgctggcccctctcagcaccccagaccctgcgagggccgctgggcagagttaatcccttaatactggtcacaatgagatttcagggatggtgggaggcggtctccatggaaactgcagacctgtccaggatccatgcaaggaattagccccagggctctgcaaggggctcctagagagccaaccccaataggaatgggagacacagtggtctggactcctgggtcctgctctggccctcctgttgtctctctggagggcttggaaaaaaccataactcttgcattgcttcagtattctgctcaactggacagagccatattcacagggagagccctatcacctttctgagcgtgtttctccatccccctattggcattgtaatccttaacccagtggcttttctagaagagtgcaggcttcagagtctgccagacctgagcttgaagctcagcttttccctccacgactgtaaacttagccgaggcatttcacttctctgagcctcagcttcctcatctgtatgatgggcacaataatagcaacatggcatccctcttgtgctggctggtgggtagtaacatccagtgaatgtgagtctccttctcaccttttcctgactgccacgcccacactgcacatttgccctccccagccccctgcagcttccagaaccccgtggtctcaagcagagagctgtcgcacttccttctttgccttctcatcctccaagtcccatcttagtcatcttcctccgggaaacagaacgccggggtcctcctctgtccccccatagcccccaaagctttacatcatcatcgtttagtcagatggtaattagactggttgtgtgcctcctccactggactgtgtcccatctaccattgtattcccaggacccacttgatataaataggctggatgaataactgagtgaataaaggatggaaatcgtccatcgaaacagtcaacatttattcagcaccttctgcgtgcatcgttgtgggtggtggagatgcagcagggaagaccatgggcaaaatatccccctcagaggggtgcagatgagcaaataaaaatacaggatgcccagtcaaatgtgaatttaagatacacaagaaatacttcgttagtatgagcgtgtcccaaataatgcatgggacctgcttatacttttaaactgtggtgttcatctgacactcatatgaaactgggtgtcctgtgttgtgtcgggcaaccctacaccctccctcacagagcttgcgttttggtggagaggcgggttgcagacataagcaagtaaatacatgaaaaacgaagtcaattacaaacagtggttaagtgcagtgaagacgcacagcgcgatgtgatagcacctggggatgggcaggacgatcccctgagctagtggcctttgcctgcacaggtcattttagctccaatgagatgccactttgcaaaagttctttgaggatcttaaagggcacggtggaggctgctaaacttgagagaaggactctgaggagggcaaggggcgcacctgagggagtggggctgctaagtctcacttgatagactccacagttttgcaacttggatctgggccttcacaaaccttcgcgaacccgcagccccacccctcgggtcagccaatgtcttctgtggggctgggagccaggggaagaggccaaaggaactgtgcagagaagcgtggccacccgggccgcagctgggagccctgacaccctttgccgccccacctcatcccgcggttgccccagggcgcagggcagggcaggcaccgcgctgggccggagggcgtcccggaggaggcggccaagactctccgcagtgctgcgctttgcgcttcctgggctcctcctcgtggccaacgcaggaactggtgttcagaaacttagatagccttagggacttcaccaatcacagcaatcccgccaatcacaggcccagacgcactatgtctctccaaatccagaggaggcctgctcggttcgatcaccaatcacagctcgttggatttagttacctaaaagaacatctccccatcacacaccagcacatggccacggcagcaatcagaacgtaagattttaaaaccagttcccagggtagcagccgctgcccttccaccacctactaaacttctgttcccagcaccttgttccaatgtacgggggtggggggggtctttgaggaaggttccaggctttgtgctgcttccatgtggaagcagatgttagcatgtatggggcatgtataatgatattactatcagtaaatgtcatacccattatgaaaattaagataggcagggcgtgatggtgcatgcctgtaactccagctttaggtggccaaggtgggaggatcgctggatcccaggagttggaggctgcagtgagccacgatggcgccactgcactccagcctgggtgatagagtgagactctgtctcaatttaaaaaaaaaaattaatgtgtggatataggagtgtggaaaaattataacctttgggttagacacacctggagcccatatactatctttgtgaagtaggacgactcacctccccttcctcagtcgtcaaaagagaatgatagtcatatctacatgtcatatatcatcacccaccttctctcaattattcaagccaacatcttgcaagtcacaatctttgtgttgtgtttctcatgccttccagttcatcagaaaatccagttcttgccaccctccaaacagaatctagattttccatctttccatctccaccccagccaaccttatgcatcatctctggaggtctgcaaaagtcttttcacttcttccctttttttttttttaaacctgccagggttggggaggggatctcccccgctccaccgccccccccgcctccccccccccccgcctgcctccaccccaccccttcactttttctcctgtggcttccctaccccctactcttcactcaggggccaagggtgatcttgtacaaatgtacattggctcagatcctcttctacttaaatttttatgacttcctatgcatttataacaaaactcatacaactcccacttaacactgtgaggccatgcacgcccttgtttttatatccctccgtgtccaacctcatttcattccacttgcccccacccctatcagcagcaggcatactagccattttaaagtttttctttcctgtcttgggggcctttgcatatactttcccctctgcctggaatacttctttttttttttttttttttttttttaagatgaagtttcgctcttgtcactcaggctggagagcaatggcacgatctcggcttgctgcaacctccgcctcccaggttcaagcaattctcctgcctcagcctcctgagtagctgggatccacacccagctaattttttaatttttagtagagacggggtttcgccatgttggccaggctgatctcaaactcctgacctcaggtgatccacccacctcggcctcccagagtgctgggattacaggcatgagccaccacacctggcctggaatacattttagtaagtgtttaatggatagttgttggatgaatgactgaaaaggtctttcaagaggaactgatagtgatgtaaacttcaagtgctcggtgcgtaacaggtattcaatgaaaaggattctatgcatatagtagaaattttggaaaataaaataaaaattgaagatttaaaaatcgtatgtgctccaacatttagaaaggttcaaactcttaatggctaaccagggtttcttgacctaagcactaatgacatttgggctagagaattctttgtcgtggggactgtcctgtacattgtccctggcagcatgtctggcctctagccactagatgtcagcagcacttttccctaccctcaaggtgtgataatcaaaactatctccagacatttataaatgtcccttgggggttgaaattatctccactgagaaccactgtgctgggcttctacccttacaagaaattttctctcagtcattcaatgcttctcaaatcttggtgtccataagaatcatctggggccattattaaaaattcagatggcagctgggcgaggtggcttacacctgtaatcccagcacttcgggaggctgaggcaggtggaccacttgagttcaggagttcgagaccagcctgccaaacatggtgagacctcgtctctactaaaaatacaaaattagccgagcgtggtagcacatgcctgtaatcccagctacttgggaggctgagacaggaaaatcacttaaacccatgaggcagaggttgtggtgagccgggatcgtgccattgcactccagcctggttaacaagagcaaaactctgtctcaaaaaaaaaaaaaaaaaaaaaaaaatcagatggtggctgggcacggtggctcacgcctgtaatcccagcactttgggaggtgggtggatcacctgagttcaggagttcaagaccagcctggccaacatggtgaaaccctgtctctattaaaaaaaaaattagccaggcgtgatggtgcatgcctgtaatcccagctactcgggaggctgaagcaggagaatcgcttgaacctgggaggtggaggttccagtgagtgaagatcgtgccactgcactccagcctgggcgccagagcgagaccctgccttaaaaaaaacaacaaaaaaaatcagatgcctggggtcctacctccaggtgccaggaccaacagtgggcctagtcatcagattaaaaaaaagaaaatatttaataaatagaggtggggcatggtggctcatgcctgtaatcccaacactttgggaggccaaggcaggtggatcactggagactaagaattcaagaccagcctggccaacatggtgaaaccttgtctctactaaaagtacaaaaactagctgggtgtggtggtgcatgcctgtaatttcagctacttgggaggctggggcaggagaattgcttgaacctgggaggcggaggttgcagtgagaagagatcaggccactacactccagcctgggcgacagagtgagagtccataaattaataaacaaacaaattaattaattaaaaaatagagacggggggaggtgtcttgctatgttgtccaggcttgtcttgaaccccagcctcaagcaaatcagcctcccaaagtgctgggattaaaggcaggagccatggagcacctggcccaagtgtttaatgagcttctgggcacttctgataccaggtgccctcagaccgcactttgaaaactcctcaaggaggcctctcaatcacctgatcaccaaaccctgtgtgaggctccctacccacctggaccctctccttgaattcctctcctttccaattattacccttccctagatagcaagtggtgacagaaccaaaccctagctcagccaaagcccaaattgcctcatctcccttcagggaataggcaaaaaaaaaaaaaaaaaaaaaaaaaaaagatcacagagttcagctgaaaccacttaggaaatatcagcatccccacctccccacccaaaaggactcctgagtggcagcctgagaggtgtgtctgctcatcagaataatgttgtcagactgtgttctttctgggggatcatcacactcccttttctgggaacaaatgttggccacttggtgggatgggccatcatgatctacgtcagacaaattcagtgagtcatgactcagcctatctctctagacccatcttttatgcccccttacttatagtctctctgagggctgttctcaactattctatttctctcctttccggcacatgatggggattacattttcttgcttcctttgaaatgagatgtgaccatgttacttgtttcaggtaacgagatgtgagcagaaacaacctgtgtcacacctgggcagaagctttaaaggccagtgctgcccttgttggggaagcaagtatagatatgaatcgttccacaacgcggagcgccccctgccgacccatgctgggcgtgtactataggtgagcaattaactttgctgttcaaaccattgagacttaggggtttttttgtggttgcaagctaacttcacttcacttgactgaacacagtctttccaaagtttcactaattttttaatgaccattatgattttttcatatctgtaacatttttcttacatcaactcacttctttttacttcaatttattttagaaagaaatattattactaccaaatgaaacagtatcataagtagaaagcaatgagaaaataaacagaatgaaagaaatcctgatatcaaatcctgacttaatactatttgcctttcaaagcctctggacctttggtctttatttaaaaaaaaaaaaaaaaaaaaaaaaaaggagccaggggccaggcgtgatggctcacacctgtaatcccaggaatttgggaggccgaggtgggaagatcacctgaggtcaggagttcgagaccagcctgaccaatatgaggaaaccccatctctactaaaaatacaaaaattagccgggtgtggtggcatgtgcctgtaatcccagctactcaggaggctgagacaggagaattgcttgaacctgggaggcggaggttgcagtgagccgagatcgctccattgcactccagcctgggcaacaagagtgaaactccgtcttaaaaaaaaaatgggagccaggtgcggtggctcatgcctgtaatcccagcagtttggggggctgaggtgggcagatcacttgaggtcaggagttcaagaccaccctagccaacatggtgatatcctgtctctacttaaaatgcaaaaattagctgggcatgatggcatgtgcctgtaatatcccagcctcttgggaggctgaggcaggagaatcacttgaacccaggaggcggaggttgcagtgagctgagattgtaccactgcactccagcctgggggagagagttgagactccgtatttaaaaaaaaaaaaaaaaaagaggtccccaagagtacttctcaatcttttggatccccaaagctgtctaagattgtcagaatatttgaaggcagcacagtattgaggctgagtgtaccaattctggaacttgacatcctgggcttaaattctggttcagtcatggactagctgtgtgaccctggacaagttactgaactgctctgtgactgttttcttatttgcaaaatagtgaccataatgatgtgtatggcattaggtcgtggtggggattatttgtgttaatgtataaaaagggcttagaagtgtgcctggcacttagtgagtgctatggaggcattacctataaaatgatggcaggatccagatccaaatagatttggtgaattattgtttgttttttttgagacagggtctctgtcactcaggctggagtgcagtggcgccatcacagctcactgcagcctccaagtctccaggctcagatgatcctcctacctcagcctccagagtagctgggactacatgtgtggaccaccacccctggctaatttttctatattttgtagatatgggatttcaccatgttgcccaggctggtctggaactcttgggttcaagcaatctgccccttcttagtcttcaaagtgttgggattacagacgtgagtcaccccacccagcctggagaaatgtttgaactccatggagataagtaaaaaatcctctgcattggttaaaaataaatcacctggatgatttatttatttagtgtagatgggaaaagctaccttagcagaaagtgacatagcaaaattctagaggttttacttggtggcagctgcccaaacctctaacccagtcgtatgtatcattagagagaatgtagttcccaggtcagaggagctaagaggtccttggcattctactcctaaggagcatatatggacaattgtgtttagttttcattttaatatgaatacttaaaattttcctaggatggcagaggatgagaaagctatgccccttaggccgagtgcagcggcatggctcatgcctgtaatcctggcgctttgggaggccaaggcgggcggatcacgaggtcaagagatcgagatcatgttggccaacatggtgaaactccatctctactaaaaatacaaaaattagccttgcgtagtggtacgcacctgtagtcccagctacttgggaggctgaggcaggagaattgcttgaacctgggaggcggagggtgcagtgagccgagatctcgccaccgcactctagcccggcagcagagcgagagttcgtctcaaaaaaaaaaaagaaagaaagaaagaaagaaagctatgccccttgaagaataatcaaagatccaaaagagttttgggctgggtattggagaagaggagagaaaggtggtgtagcagagtggtcagggccattgcctttgaaatatcagtggtgccatttacatagctgttggaccttgctaaaatcataagctcttcaagccttatttgcttcatctataaaataggaatcaatgataggaccttttcatagattgctttgtggagtaaatgtgttaaaccttataaacctggcaggtagctgcccagcatatagttgcgttatttactcaattcaaagtactttcctgccgggtgcggtggctcaggcctgtaatcccagcactttgggaggctgaggtgggtggatcacttgaggtcaggagttccagaccagcctgaccaacatggtgaaaccctgtctctactaaaaacacaaaaattagccgggcgtggtggcagtcacctgtaatcccagctacttgggaggctgaggcacaagaatcacttgaacctgggaggcagaggttgcaatgagctgagatcgtgccgctgcacgccatcctgggtgatagattgagactcagtctcaaaaaaaaggcaacaaagtactttcctttggaaaagagtgcccactggctgggtgaagtggctcacgcctgtaatctcagcacttgtggggctgaggcaggcagatcagttgaagccaggagtttgagaccagtttcacgtggccaacatggtgaaaccccgtctactaaaaatacaaaaataagccagatgtggtgtcatgtgcctgtagtcccagctactcaggagagtgagacaggagaatcatttgaaccctggagttggaggttgcagtgagcagagatcgtgccactgcactccagcctgggtgacagagtaaaactctgtctcaaaaaaaaaaaaaaaaaaagctctcactgattcctacagcttcagagaatgaacgaggaccaaaatgtggatgctacagggaggaaacttgaggctcaaaatggagatctttctataaaatacaattgttctaccacaggaaaagctgctttattaagtagtgagtattccgtcattggaagtattaagcccaagctaaatggtcaactgtcagggaaggatggtgagaggattccagtgggttagaggtcaaagagcgtctaccaggtgcaaaagtcttaattaacaaagtactatcaaaaccaaattcatgtttgggaaactgtatatccacatgcaaaagaatgaaatcagactctttccttacaccatatacgaaaattaactaaaaatgagtttgacggaaaagtataaaacctttggaataaaacataagggaaaagcttcatgatattagatttggtgatgatttcttggatatgacaccaaaagcacaggaaatttttaaaaattagataaattggactacatcaaaattagaaaaatttgtgcaccaaaggacacttgactgagtgaaaaagcaacttacagaatgggagaaaatatttgccaatcatatatctgataaggggttaatgtccgaaatatataaagaactcttacaactcaataacaacaaccaaaaactttaaaaatggacaaagaggccaggtgtagtggctcaagtctgtaatctcaccactttgtgaggcagaggcaggaggattgcttgagctcaggagtttaagaccagcctgggcaacatagtgaaactttgtctctacagaaaaatttaaaaattagccaggcatgctgcacacctgtagtcccagcttacttgggaggccgaggtgggaggaccacttgagtcaaggagtttgaggctgtggtgagccacgatcctgctgctgcactctagcctgggtgacagagcaagacctgtctcaagaaaacaaaaaaattggcaaaggacttgaataggcatttctccaaggaagatatacaaataaccattaagcacataaaaagatacttaacatcactaatcattagggaagtgcaaatcaaaactgcaataagaggctgggcacagtggctcatgcctgtaatcccagcactttgggaggccagggcaagtggatcacttgaggtcaggagtttgagaccagcctggccaacatggcaaaatcccaaatctactaaacaatataaaaattatctgggtgtgggccaggcacagtggctcacgcctgtaatcccagcactttgggaggccaaggcgggcggatcacgaggtcaggagttcaagaccagcctggccagcatggtgaaaccccatctctactaaaaatacaaaaattagccgggcatggtggcatgcatctgtaatcccagctactcaggaggctgaggtaggagaatcgcttgaacctgggaggcagaggttgcagtgagccaagatcgcgccactgcaccccagtctgtgccacacagtgagactctgtctcaaaaaaaaaaaaaaaaaaaaaggaaaagaaaaattatccgggtgtgatggcacatgcctgtaatctcagctacctgggaggctgaagcaggagaatcgcttgaaccctggaggagaagtttgcagtgagctgagactgcactactgcactccagcctgggcgacagagcaagactatgtctccaaaaaaaaccaagacaaacaaacaaacaaaacacacaataagagaccacctcacacccattaggatggatattataaaacaacaacaaaacagacaatagtaagtgttggtgaagatgtggagaaattgtaacccttttacgttcctatcactgctggtgggaacgtaaaatagtgcagcttctgtggcaagcagtatggcggcttcctaaaaaatgaaaaatagaactatcatatgatctagcaattgtactcccgagtatatacccaaaagaaccaaaagtagcatctggaagagagatttgtatactcaagttcatagcagcattattcataatagccaaaaggtacaggcaacccaagtgtcaatcaatggatgaatggatcaataaaatgtggtatatgcatacaatggaatattattcagccttaaaaaggatggaaattctgacacatgctacaacatggatggatcctgagggcattatgctaggggaaaagctagtcacaaagaacaaatactgtatgattccactagcctacaggaaagtagtcaaattcacagagacagaaagtagaaggggtttgccagggcctgggaagaaaggagaactattttcttttcttttcttttcttttttttttttttttgagacggggtctctctctgtggcccaggctggagtgcagtggtgcgatctcggctcactgcaacctccacttcccgggttcaagcgagtctcctgcctcagcctcctgagtacctgggattacaggcacgcaccaccacgcccggctaatttttttgtatttttagtatttattttgtatttttagtagagacgaggtttctccatgttagcctcccaaggggagctattttctaatgggtacagtttcagtgtgggaagatgaaaaaagttcaggtgatggatggtgctgatggttgtattacaatgtgaatatatttaatgtctctgaactgtacgtttaaaaatggtcggctgggcgtggtggctcacacctgtaatcccagcactttgggaggctgaggtggatggatcacctttggtcaggtgttcaagaccagcctgggcaacatagtgaaaccctgtctctactaaaaatacaaaaatcagctgggtgcggcggtgcatgcctgtaaccccagctactcgggaggctgaggcagaaaaatcacttgaacctgggaggtggaggttgtagtgagccgagatcacgccactgcactccagccgggcgacagagtaagactctgtttcaaaaaaaaaaaaaaatacatgcataaaagatgtttctaagagtgctaaaaaatgcctacaaattgataaggaaaggtaaataatacaatagataaatggtcaaaggatacaaacaagcacactcataatgtaggaagctcaaatggcaaaagagcctctccttctctagtaatagaggaaatgtaaatttgaaagtgaagcataattttacattcagtatcttacaaaatcaagtgctgatgaggttgtagagcaaccaaaactctgtaactattgttggaagtggaagttggcattcaagaatgagcaatttagcaacatctcttaaaagtgttgatatccactgtctaagatacagaaattccatctctgcatgttacctagagaaactctcatccacaggtataagaatagtctttggagcatcatctgagatagtgagccaagatcgtgcaactgcactccagcctgagtaacagagtgagactccatctcaaaacaaacaaataaacaaaacagaataaatatactcaggatatttaca

SEQ ID NO: 194320 - DNA, 30003 bp, Homo sapiens
agtgcccagcagctgcctcctcaccctagctgagctgaccacaagattccagacctcagctggagctgcagcctcatactggctgagtggctccaagacacagaaggaagcagggtggcaggctgacctcagccagctgcctgccccctctcctctgaggctggcctgggaccgatggggctcttccctccaggaggggtttccgggcctcctcttttcccctacctccctgtggagaactgtccacccctccagatatgctccagtgatgtcggaggggatgcctcaatctggcgagacgcagcggcaacaaaatctgctcagagacaaacggacatgttgctgatatgaatctcacttggtgagtggcaacaacagagtcctgcatttgggtctgtgcagtcgtgcacaccagagaccgctgacccccgcccgcagcacagggaactgcatatatacacagcaggtacaaatatgggcacacgacaaaacgcccatacaggataaagatgcaggaagaacagggcactccaacaggtccgcatgcacaaacgcatgtgctctatgacccgcacacacagcacacatgtacaaacatccacagacacaagtacacacacatacacacttacatacataagcaagatcaacacgggcaactcctaagacacaaacacagacccactcaatgaatacaaaggaaaatagacccagaactcacacacagagacaaatgaacacacatatgcaaatgggttcctgaaggcatcaccccacccatacaacctacatggaaactcactatcacacacgaacgcacacacaacacacacagtgctgagttggcttcgtagttagcaaaacttccctgagagctccattttccctaagtgccaatttcatttccctaggaaagtcccaaagacaccgagaaatgcggttatgtctccaaccaccatctccagggatacaacatcccttgccgtctctctgaacctaggcccaaggggttcacgaaggggccgtgctgggctgaatcgctggagctgggcaccaagggggagctcaccatcacgtcactgtgccaagcgccaagcagagccactgtgaggcagtgaggactggaagggcctgggaggaatagccgggatcgacttttgctggaaattggcccttgcaggcctcccttcacccagaatgcctgtgatcactgtgcctgggcacatgggcttcacttggcaacacctgtgctggcctgtaggaccaacctaccattttgtatcattctcctcccaccccaaagttgagtgccaaagatctgctcctggacccaggcacacctgcccccactggcacacctgggcacatctgcccccacctaccattgcccatcgtcaacacctgcacattctcaaattccagggtggtgtaggctgggtccagtgcagcactgtagtcggccatgtccatgtcgacgagggttttggagagtcgcattctccctgcctccacgccgcggccacctgccctaccctgggcgcccaccccgaaggcccccgccctccgccctcccactgcctcctcccagtgccctctctgccttcctttcaaaccgtcctctgggaagatctgctgggagtcttggcctagcctctgtgaaggggtggaggctctgccggggaggggtgggggttaatggttaatcggtcccccgccggtggataggctgggcggggctgcagggatttggctgtttgttggtttctggctgacacccggggtgctaattacaactgctggggccctaactcaccgatgttcagttatcaattgtacaaggcaggcatcatgactcacgggcactcatttgacccttgactcacccacccctccaagccattgtcaccccaagtcaggcattctaactgatactatcaggcactgacagcctacctccgagatcccctaattcaataacttcccaaatcattgacttctaccctcaatgcttttgcagagataaggctgccccatggcccacgatttagaaacctaaatcccaggccccagatgccaatcttctggatccttgttctgggagctcccttccagttcccccgcagtttcccggttcccctgggagcagaatggactggaagtttgggagggccagattcacctccaattccccgctcctgctccctgtgatcccaccctgcccctctccgtctcccacagctcccagtgtttctggcccaggctggctccatctcggattttcccatcacattctcctgtttccctcacccccaccccctcccggagcaggcagagacctggatttacattcaggcacctaccgtctactaactgggaccttgggtaaatgattctcctctccgagcctcagtttccttttctgtaaaatgtacaatcaacttcaaagggtggtttgagaaggaaatgagatggcataaatcaagcaccaagtggggcctggtagacgtccatcctcttccccctcctccctctccctgtttcgtatcccccttgccatccccctgtttctctccacccgtctcctaccttcagagtgggctttgtgggggtatcgccagtgcagtcacaggcaacccaacccttagaaagtcctggttcctggttcagtgctctgctgtggttgtcctaaaattcatcatgacttttgaacaagggattgtgcatttttgttttggacggggccctgaaaattacacagctggtcctggctgtctgaagctcatggtgcactctgttcttctcactccctccagccctcattgccttctgtgcagacattttcaagggctgccaatcaatctggggaagtaaagtcttgatgtagaaggcagagagtgagggcagaggaagaaaagcctgagacttgggaggcctgggagcctgtcctccactgctggctggaagggcaggttggagggcctcggtgacacctgtgagcaagagtgggcgaattagtgggagcaccaattaatgagtgagtgtgtgggggaattgatgagtgggtgaattaggagtgagtgaattagagacagggagaattaatgagtgagttgagtgaatgcatgaatgagtgagtgaatgaacgaatgagggtaaattactgagtaagtgagcaaatgggtgggtgaattaatgagtgaatgggtgggtgaattaatgagtgagtgaatgagtgaatgtgtgggtggattaatgagtgagcaaatcgggagtcagggcatgtgtgttcgagtggtatgaggaggcatcttcatgttctttccactgctagaagccctttctctgccctgcttagctttattctgtccacttgatctgacctctgaagctgagatgactggggagtgctattgcctgtagggaaaggggagagggagcaactgttgtggaggacaagagaggctagatttgatgtcaggagacctggggttaggaactagctcagtcactattccgataactttatttacatcgtctcttctcagggcttcaatttctccctctgtaaaatagaaagatgatcctggctcagttttctgttagccaggacaagactctgagggagggagcaagaggcagccccctgcaacccacactatgagacttgataaggggctgaaagagaccaaataccggcgggttcctcccatgcctacctcaggagtatctgacctggctccaccggccttgggggcagtgcagaggtgggaagaaacagaagatccgaccaaggggtaaacacagaagagatgtggagggcagctccgggaggagcctccaagggctgagcccaggcctctgccacctgcctggcacctatggcaggccacaggcacagctactccccacacaatccaggaatacatggcctcttccactctgaggcacagttccacattgcttaacggggaatgtgatcaatgtcatgtcagaatttcattggcaacaaaaataacaatgcatttttccatagatgacatcttagattcaattaaataaggtctacgatcaaccaagatcaaccacaccatgccacagccatgacccgttatatccaagagctactaggtggacactgcaaatgaagagctattagatacatgaatcatgacatacctgacttaccaaatgcacaatctgcatgactgcctaggaggcacattctagattcacatcccaccacattataacctaccccataagtaaatctatccactcatcactgtaaattgcataatctattacatacatgattcattccacccttagccaacgccaaacagtatctcctagatacacattcctcatataaatgacgcaccacctataagatctgctggctctgtgacctcaggcaagctattatttcttttgttcttgttgttcattgttactacatagtttatttaaaccaagctatgataatacagctgcccagaatctttgtggattacagatgcaaagtaactggagacgtgtccttgcacctatagttcagtaatagacagaaagtttgttacatttactaagtacagagaactgaatacacatgacattgtacatccatctttttgctttgtatttccattttaaacatatgtatgttacaactttacattttaaatatgactccatgtattttgtgacaatggctaagaacgcaatgatcccatgcccctgaaataagcacactttggtctgcaatgcagaatgttttcattggggtaccaaacaaacccttaacacataacagacaaaaactccttaaaaatcagatttaatacaatgttcttcatgttagataaggagaaagaacgggaggtggaaaaggaaaacattggggtactttaaatgtacagtgtcttgagaccttgaaagtttcaggccaggcacaggggctcacacctgtaatcctagcatcttgggaggccgaggcaggcagatcacctgaggtcaggagttcaagaccagcctggccaacatggagaaaccctgtctctactaaaaatacaaaaatcaaaaattagctaggcatggtggcatgcccctgcagtccaggctacttgggaggctgaggcaggagaatcacttgaacctgggaggtggaagctgcagtgagccgagattgttccactgcacctgggtgacagagcaagactctgtctaaaaaaaaaaaaagaatgttttcttcaggggatgaagagacgttggttcatgggtacaaaaataagtgagatagaaggaataagatctagttcttatagcacagtagagcgattatagttaacaatcatttactttatatttcaaaatagccagaagagaagatctgaaatgtacccaacacaaagaaatgataaatgtttgaggtgatggatatcctaaatactttgcatggtatgcatgtatcaaaatacatgtgctccatatatatgtacaattattatgtatcaattataaaaagtttcattcccttcctccaagggattttttttttaactagtggaaaaaagaaagcaacttcataacgccctccagtgaggaagaacattatcctgacaatgcttaggtgctttcatatgagcacataataaatacaggaagtcacagagcaaatgtcacagtattggtttggtttttatttctatgcttataaaaaatattaagcttctttctgtggactgagtgggtgttagcctgtgggtattggtctctggtgcctgtataccagtgactatttatattccaagcccagggccagctgtctgcacaaggcaagtttttatttcgaagccttggttactccttctgtacaaggggtctaacttgtcgtttgtcgtgaagattaaatgagagagtagataagcttcttagcctctcttcccctgacctctctttaggggaataaaccacagaccttgtgggtcagatagatctaggttaaaatccaggcagtgccaatgtaccaaactctgtgacctcaacttctacttttctcagccttagtttaagcatcagaaaaattgggttgataccttctttgtagggatggttcaagcattaaatgaccacgtgtaggcatacagtacaatagtagcaatcactgtcattggtcattgattgcatgacacactggccacataatcagttggaatcaggacccctgctcaggacagctccaggtaccacacacccagccatgaacaagcactagcctcaatgccatcaatttagcagctgttctttacctctgctcacttgctgtcgggccccagctcaagaggcagcagattccaggggatagcagaggacctcagagcccacagagagacccagttgagacgggaagggattgccctgggcaacctgcagttggggaggcatgtgtagggagcttgtgcctctgctgtggacggtggtaagggagctgccactacgaaccacattgtttctcttttacattataataaggtctaatgtttacagagaaattttgtgctagccctggtgctaaaaaccttctagccttctcatattatctgcctgttgagataggggctattgtcatccccattttaaagatgatgaaattgaggctcagagaggtgaagtgacttgcccaaagccacacagctcgtaagggaggggctgttgtttgaacccgagtctgcctccagagcttgagggcttcacccctctacgcattgcctgcatcatgactcctggaatccctgaaaggacttcggaattctaaggcactggagctggtggtttcactgcctcagtcttgcaggggaactcaaggacctgagaagtaaagcaccttatcccggggtataggcaggggcaggggcatcctccacacgcctggccaccccagggctgcttggcatcttcacttccccttggcgctcaccacaccattatctcctatcttttcttccccacccaccactccgggagaggtgcagagaaaactgggacttatcaagacaaagaacaaaagtcgtggaggaaagaagccaagagccatctctactctggggtagggcccttcagttttgcccctttgaaatttcaaattccagtttgtggacaaagtcctaactatctcacaatataggtccccaaccactgaccaaactccagtccaggcagccaccagctggcctggtcttgctgcttcctttagcggcttccaaggtccagggacagggggtctgggccaccaagaggctctgctaggctgtccctgcagccacagccaccccactggacccctgcctcccatctgagaggacagccctcttcctggagctgggatctgacacttgctgataccaacggcagataccaggtaggtcccctccctttctcttccttgagctcctaaaatgccactcataccaccctctgcactcggcaaaggccactgtggcttaatcaaatcaggcacccacaaagcttcaagactggaaaagatgccttggctaacccacccatttagtggacggaaacactgaggccgtcaggggagtggcagctggccacagactgaaccatagacttggggcccagacctggggcccctcacggagcctcagagggtgaaagggacttgctcaagtccacgcagcggtggtgggtgagctttgtcttaacaacgagcactttctacttcatcacagaccatgagtggcattgtgtttgttcacccgatgatgggtggccactggcttgttcacccgatgatgggtggccactggcttgtcacaggagtatttccgagaggaagatgagggagcttggggctgaaggccagtgggtttggaaggaagcaacattcatgtggttaactgataactgggccccatccctgggcctccttcctccctccctgtccttagcctgattaagaccaacttacccagctgctaatcattgctgagcctgttgattttgccttaaaaaattaactgggcatgagtttgcggttttcctcacccctaaccctgaaaaggcctgggtgggcaggaggcctccagggttatgcaagaggccgctggcctcccaacgcatagcccacggccacctcggctgctctccaaagaagaggctttgctcaagagtcaacagtctgcttgttccccctgtgctgggtcctgagcaaatttgctctgttaccaaagagagataaaggcagctgggggagagctttccaaacagggatgggaagcggcagctttgagcttggggttctagaactctgcagtgtcagagccaggagaatctttaggaggatgtgggctggggtttttcaagctgggttccgaggctcccaggagccaagggtatgcatccacaggcccagcttcaaccagcgactcccttttacatgtagtcttaatattttatttgagggttggaaaaccactgattcagccccatcccctcattgcacagatggggagatggagatcagagggggaagtgacttgtccaaggacagaaggtcacctcgggtattcaggggctccagccagcatgggaatgaatggtgggctctctgtggacccgggcaatgtcttgaaagacattggtgaacaagacggctctgcaaacgccttgccatgccgttctccccctcctcccagggctggctggaagcagagaggtgcctgagagccattggaagacccaagtcaggggaatgcacctggctctgtgtcccatgggccctgtgaggatatgaccagcagccaggcactgcaaaccggagactacgttataatccatctcagccacgtcctgtctctggaggcatcagcactttgggaggctgagatgggaggattacttgagcccaagagtttgagaccagcctgggcaacatagtgagaccctgtgtctattttttaaaaagattttttaaaattaaagacagatgcccagtccctatcacaaaaaaagatgtagagccctgccctgactctctccacctctctgagcctcagtttcttcacctgtaaattgggaattataatacttaacttccagggttgtcatgaaaatgaaatgaagcaaaatatacacattgatcatcatggccactggatatgcagctgttttaggagctttgcatgtgttacttccttgatcctcccagccactctgggaggtaggcaatgttttcaccaattttttacacaccagaggcacagggaggttgagccatatacccatgctcacacagctgatgagaaacaagaagtggaattggaacttgggcagtctgtctctagagtctgtgcctctaactccagggctacccttcccttccagggatgccagtgagagatggccaggagaagggcagagagcagggcactgtgggagatgctgactgtaaggctccggaggtagggcagagagtatggtctggagaatgatcaggaaggaagccaggaggacttggatctgtgtgggtggagcttctccgcaggctgcctcctgccaggtggcttatgacatctgggctgagggtgttgctgtcctcctgtttatgttcatccctcctgtttatgttcctgaatttatctgcaggggtgaccttgggaattagatgcggccttcccggcccttgtggggcctgaaggctgatgggagcccctgcctgacccagactctggtttggggagtgagggctgagcccacatcccagaagccacccttggtctccccatactcttgttctgaggggccccagggatttgccaggtcactaaggtgaagtgtttggaagtcctgaggctcagatcagagttactgccctgtacagttgtgcaggttgctcactgcacaaaggttctccagccaagagggcaggtagggatggaaacccagcccttgttccacttgccaagcgaagtgcccatggagctctgcctgcccagagtggggtgcctttttcttatttgccctagggcttcatgtaagctgctgggtgtcctgccccagctctggttccagccactgtgtgtccttgggcaaggtcatttccctccctggccttggtttcccattggagaagttttgtctaacaaagcagagactcatctctgaagatgaaatagaatcatctgaaacctttaaaatatacagatgttggccgaacatggtggcttacacctataatcctagcactttgggaggctgagatgggaggtttacttgaacccaggagtttgagaccagcctgggcaacatagtgagaccctatgtctattttttaaaaagattttttaaaattaaagacagatgcccagtccctatcacagatcaatgatcgaatcttggggtaggggtggggaggtgccaggcgtctatatttttgtgcagccaatattgagacccactgtaggggggcttcaaatttgaacctggaaagccttcgatggcatcaagttctatcacttactacaacttactagtcaaaacctcagcgaggctcagttttcccatctgtaaagagggaatgatgatcgtttcctcacaaaatcaaaatgccaattaaatgagataatgttcagacagtgcttggcaccatgttccccaagtagggagctcctgattcttgctaccaagactattattgttgttatgggcaatttgacgttgacaaaataaagggcctttctaggtcaaggattcggtgacttgaagacaggcctcctctgttgctttgagtcaatttctagtacctgggcctaaatcttgactgcacaccggtcatattattgaggtatgtgttattattattatttaatattttacttaatttgtgaacatctttacatttagttttgaattggtgctacattcgcatggttcagaatcaaaacataaaaggtgtaaattgagaagtcttgcttccagctgtctcctgttcacctgttctccttgacttcctcactatggggaaccacatcccttacagatgtatctgccaaggtttctttatacagaccagatagcatgtaagatcatacatgagtagcctctgctcttacactgttctgtatcttgtttggttcatttaatatcacaacctggagatgcttccatagcagctgagagcaagctttgaggatggaagggttctcgtctcccatcacaggtgaggaaactgaggctcagagaagaaacatcattttcccagtgagccaaggcaatggtgttagaactatctctacctggctccagagcttgtgtttatgcccctgcaccgatacggccttccatgaagcccggcccagaaagctttggagtctggttacatctctgccatgcaggcctggccttcccaggacaagaggtgaggaggggggctgtcggggtcctcactgtgtctggactcagaaatcccaaagagaggatgaagtgtagaacaaagaatgtcccaagtcatccagatagggacccagtgggaaggtgtcccctggatggaatagtgggggcctggtggctgtgcccgtcagcactggagaacctgccaggaactctctgccagcctcaggtggtgcgggtggcaggggaagtcaggaggaggatgagaggcagggagggaagcatggccgatgagacaagctctgggtgaggggatggaggggaccccatgcctggagctcaggaaggaggatttggagttcaaggcagaagtggcaatgagattttaaccgattgttttctgctcagggaacttcagggttccctctggattcttgacctgcttcagtttgctgactcactggctttgggcaagtcattttccctctccgtgcctcagtttccccaactgcaaaatgagagagataagagatctggtctttaggcagccttggactacccctaatactctacggggctcctctcaccttgttgaggtcgtctggattctccttctctgattggaacgtcattcacccatcagggccatggacgttcctgggttaggggatgagggtacaaatcctccacactgctcccagtctggaatcctcccccttggttctgtgtctctctcctaccatcccatccttccttccaggcagatgtggagtcaggaccatacctggtgggtcctgggggaagccctggccccagtccgacatcctcctcctgctgctatggggtcccgcacagtgcacaacctcttcatccttgagggagctcctgctggcccctctcagcaccccagaccctgcgagggccgctgggcagagttaatcccttaatactggtcacaatgagatttcagggatggtgggaggcggtctccatggaaactgcagacctgtccaggatccatgcaaggaattagccccagggctctgcaaggggctcctagagagccaaccccaataggaatgggagacacagtggtctggactcctgggtcctgctctggccctcctgttgtctctctggagggcttggaaaaaaccataactcttgcattgcttcagtattctgctcaactggacagagccatattcacagggagagccctatcacctttctgagcgtgtttctccatccccctattggcattgtaatccttaacccagtggcttttctagaagagtgcaggcttcagagtctgccagacctgagcttgaagctcagcttttccctccacgactgtaaacttagccgaggcatttcacttctctgagcctcagcttcctcatctgtatgatgggcacaataatagcaacatggcatccctcttgtgctggctggtgggtagtaacatccagtgaatgtgagtctccttctcaccttttcctgactgccacgcccacactgcacatttgccctccccagccccctgcagcttccagaaccccgtggtctcaagcagagagctgtcgcacttccttctttgccttctcatcctccaagtcccatcttagtcatcttcctccgggaaacagaacgccggggtcctcctctgtccccccatagcccccaaagctttacatcatcatcgtttagtcagatggtaattagactggttgtgtgcctcctccactggactgtgtcccatctaccattgtattcccaggacccacttgatataaataggctggatgaataactgagtgaataaaggatggaaatcgtccatcgaaacagtcaacatttattcagcaccttctgcgtgcatcgttgtgggtggtggagatgcagcagggaagaccatgggcaaaatatccccctcagaggggtgcagatgagcaaataaaaatacaggatgcccagtcaaatgtgaatttaagatacacaagaaatacttcgttagtatgagcgtgtcccaaataatgcatgggacctgcttatacttttaaactgtggtgttcatctgacactcatatgaaactgggtgtcctgtgttgtgtcgggcaaccctacaccctccctcacagagcttgcgttttggtggagaggcgggttgcagacataagcaagtaaatacatgaaaaacgaagtcaattacaaacagtggttaagtgcagtgaagacgcacagcgcgatgtgatagcacctggggatgggcaggacgatcccctgagctagtggcctttgcctgcacaggtcattttagctccaatgagatgccactttgcaaaagttctttgaggatcttaaagggcacggtggaggctgctaaacttgagagaaggactctgaggagggcaaggggcgcacctgagggagtggggctgctaagtctcacttgatagactccacagttttgcaacttggatctgggccttcacaaaccttcgcgaacccgcagccccacccctcgggtcagccaatgtcttctgtggggctgggagccaggggaagaggccaaaggaactgtgcagagaagcgtggccacccgggccgcagctgggagccctgacaccctttgccgccccacctcatcccgcggttgccccagggcgcagggcagggcaggcaccgcgctgggccggagggcgtcccggaggaggcggccaagactctccgcagtgctgcgctttgcgcttcctgggctcctcctcgtggccaacgcaggaactggtgttcagaaacttagatagccttagggacttcaccaatcacagcaatcccgccaatcacaggcccagacgcactatgtctctccaaatccagaggaggcctgctcggttcgatcaccaatcacagctcgttggatttagttacctaaaagaacatctccccatcacacaccagcacatggccacggcagcaatcagaacgtaagattttaaaaccagttcccagggtagcagccgctgcccttccaccacctactaaacttctgttcccagcaccttgttccaatgtacgggggtggggggggtctttgaggaaggttccaggctttgtgctgcttccatgtggaagcagatgttagcatgtatggggcatgtataatgatattactatcagtaaatgtcatacccattatgaaaattaagataggcagggcgtgatggtgcatgcctgtaactccagctttaggtggccaaggtgggaggatcgctggatcccaggagttggaggctgcagtgagccacgatggcgccactgcactccagcctgggtgatagagtgagactctgtctcaatttaaaaaaaaaaattaatgtgtggatataggagtgtggaaaaattataacctttgggttagacacacctggagcccatatactatctttgtgaagtaggacgactcacctccccttcctcagtcgtcaaaagagaatgatagtcatatctacatgtcatatatcatcacccaccttctctcaattattcaagccaacatcttgcaagtcacaatctttgtgttgtgtttctcatgccttccagttcatcagaaaatccagttcttgccaccctccaaacagaatctagattttccatctttccatctccaccccagccaaccttatgcatcatctctggaggtctgcaaaagtcttttcacttcttccctttttttttttttaaacctgccagggttggggaggggatctcccccgctccaccgccccccccgcctccccccccccccgcctgcctccaccccaccccttcactttttctcctgtggcttccctaccccctactcttcactcaggggccaagggtgatcttgtacaaatgtacattggctcagatcctcttctacttaaatttttatgacttcctatgcatttataacaaaactcatacaactcccacttaacactgtgaggccatgcacgcccttgtttttatatccctccgtgtccaacctcatttcattccacttgcccccacccctatcagcagcaggcatactagccattttaaagtttttctttcctgtcttgggggcctttgcatatactttcccctctgcctggaatacttctttttttttttttttttttttttttaagatgaagtttcgctcttgtcactcaggctggagagcaatggcacgatctcggcttgctgcaacctccgcctcccaggttcaagcaattctcctgcctcagcctcctgagtagctgggatccacacccagctaattttttaatttttagtagagacggggtttcgccatgttggccaggctgatctcaaactcctgacctcaggtgatccacccacctcggcctcccagagtgctgggattacaggcatgagccaccacacctggcctggaatacattttagtaagtgtttaatggatagttgttggatgaatgactgaaaaggtctttcaagaggaactgatagtgatgtaaacttcaagtgctcggtgcgtaacaggtattcaatgaaaaggattctatgcatatagtagaaattttggaaaataaaataaaaattgaagatttaaaaatcgtatgtgctccaacatttagaaaggttcaaactcttaatggctaaccagggtttcttgacctaagcactaatgacatttgggctagagaattctttgtcgtggggactgtcctgtacattgtccctggcagcatgtctggcctctagccactagatgtcagcagcacttttccctaccctcaaggtgtgataatcaaaactatctccagacatttataaatgtcccttgggggttgaaattatctccactgagaaccactgtgctgggcttctacccttacaagaaattttctctcagtcattcaatgcttctcaaatcttggtgtccataagaatcatctggggccattattaaaaattcagatggcagctgggcgaggtggcttacacctgtaatcccagcacttcgggaggctgaggcaggtggaccacttgagttcaggagttcgagaccagcctgccaaacatggtgagacctcgtctctactaaaaatacaaaattagccgagcgtggtagcacatgcctgtaatcccagctacttgggaggctgagacaggaaaatcacttaaacccatgaggcagaggttgtggtgagccgggatcgtgccattgcactccagcctggttaacaagagcaaaactctgtctcaaaaaaaaaaaaaaaaaaaaaaaaatcagatggtggctgggcacggtggctcacgcctgtaatcccagcactttgggaggtgggtggatcacctgagttcaggagttcaagaccagcctggccaacatggtgaaaccctgtctctattaaaaaaaaaattagccaggcgtgatggtgcatgcctgtaatcccagctactcgggaggctgaagcaggagaatcgcttgaacctgggaggtggaggttccagtgagtgaagatcgtgccactgcactccagcctgggcgccagagcgagaccctgccttaaaaaaaacaacaaaaaaaatcagatgcctggggtcctacctccaggtgccaggaccaacagtgggcctagtcatcagattaaaaaaaagaaaatatttaataaatagaggtggggcatggtggctcatgcctgtaatcccaacactttgggaggccaaggcaggtggatcactggagactaagaattcaagaccagcctggccaacatggtgaaaccttgtctctactaaaagtacaaaaactagctgggtgtggtggtgcatgcctgtaatttcagctacttgggaggctggggcaggagaattgcttgaacctgggaggcggaggttgcagtgagaagagatcaggccactacactccagcctgggcgacagagtgagagtccataaattaataaacaaacaaattaattaattaaaaaatagagacggggggaggtgtcttgctatgttgtccaggcttgtcttgaaccccagcctcaagcaaatcagcctcccaaagtgctgggattaaaggcaggagccatggagcacctggcccaagtgtttaatgagcttctgggcacttctgataccaggtgccctcagaccgcactttgaaaactcctcaaggaggcctctcaatcacctgatcaccaaaccctgtgtgaggctccctacccacctggaccctctccttgaattcctctcctttccaattattacccttccctagatagcaagtggtgacagaaccaaaccctagctcagccaaagcccaaattgcctcatctcccttcagggaataggcaaaaaaaaaaaaaaaaaaaaaaaaaaaagatcacagagttcagctgaaaccacttaggaaatatcagcatccccacctccccacccaaaaggactcctgagtggcagcctgagaggtgtgtctgctcatcagaataatgttgtcagactgtgttctttctgggggatcatcacactcccttttctgggaacaaatgttggccacttggtgggatgggccatcatgatctacgtcagacaaattcagtgagtcatgactcagcctatctctctagacccatcttttatgcccccttacttatagtctctctgagggctgttctcaactattctatttctctcctttccggcacatgatggggattacattttcttgcttcctttgaaatgagatgtgaccatgttacttgtttcaggtaacgagatgtgagcagaaacaacctgtgtcacacctgggcagaagctttaaaggccagtgctgcccttgttggggaagcaagtatagatatgaatcgttccacaacgcggagcgccccctgccgacccatgctgggcgtgtactataggtgagcaattaactttgctgttcaaaccattgagacttaggggtttttttgtggttgcaagctaacttcacttcacttgactgaacacagtctttccaaagtttcactaattttttaatgaccattatgattttttcatatctgtaacatttttcttacatcaactcacttctttttacttcaatttattttagaaagaaatattattactaccaaatgaaacagtatcataagtagaaagcaatgagaaaataaacagaatgaaagaaatcctgatatcaaatcctgacttaatactatttgcctttcaaagcctctggacctttggtctttatttaaaaaaaaaaaaaaaaaaaaaaaaaaggagccaggggccaggcgtgatggctcacacctgtaatcccaggaatttgggaggccgaggtgggaagatcacctgaggtcaggagttcgagaccagcctgaccaatatgaggaaaccccatctctactaaaaatacaaaaattagccgggtgtggtggcatgtgcctgtaatcccagctactcaggaggctgagacaggagaattgcttgaacctgggaggcggaggttgcagtgagccgagatcgctccattgcactccagcctgggcaacaagagtgaaactccgtcttaaaaaaaaaatgggagccaggtgcggtggctcatgcctgtaatcccagcagtttggggggctgaggtgggcagatcacttgaggtcaggagttcaagaccaccctagccaacatggtgatatcctgtctctacttaaaatgcaaaaattagctgggcatgatggcatgtgcctgtaatatcccagcctcttgggaggctgaggcaggagaatcacttgaacccaggaggcggaggttgcagtgagctgagattgtaccactgcactccagcctgggggagagagttgagactccgtatttaaaaaaaaaaaaaaaaaagaggtccccaagagtacttctcaatcttttggatccccaaagctgtctaagattgtcagaatatttgaaggcagcacagtattgaggctgagtgtaccaattctggaacttgacatcctgggcttaaattctggttcagtcatggactagctgtgtgaccctggacaagttactgaactgctctgtgactgttttcttatttgcaaaatagtgaccataatgatgtgtatggcattaggtcgtggtggggattatttgtgttaatgtataaaaagggcttagaagtgtgcctggcacttagtgagtgctatggaggcattacctataaaatgatggcaggatccagatccaaatagatttggtgaattattgtttgttttttttgagacagggtctctgtcactcaggctggagtgcagtggcgccatcacagctcactgcagcctccaagtctccaggctcagatgatcctcctacctcagcctccagagtagctgggactacatgtgtggaccaccacccctggctaatttttctatattttgtagatatgggatttcaccatgttgcccaggctggtctggaactcttgggttcaagcaatctgccccttcttagtcttcaaagtgttgggattacagacgtgagtcaccccacccagcctggagaaatgtttgaactccatggagataagtaaaaaatcctctgcattggttaaaaataaatcacctggatgatttatttatttagtgtagatgggaaaagctaccttagcagaaagtgacatagcaaaattctagaggttttacttggtggcagctgcccaaacctctaacccagtcgtatgtatcattagagagaatgtagttcccaggtcagaggagctaagaggtccttggcattctactcctaaggagcatatatggacaattgtgtttagttttcattttaatatgaatacttaaaattttcctaggatggcagaggatgagaaagctatgccccttaggccgagtgcagcggcatggctcatgcctgtaatcctggcgctttgggaggccaaggcgggcggatcacgaggtcaagagatcgagatcatgttggccaacatggtgaaactccatctctactaaaaatacaaaaattagccttgcgtagtggtacgcacctgtagtcccagctacttgggaggctgaggcaggagaattgcttgaacctgggaggcggagggtgcagtgagccgagatctcgccaccgcactctagcccggcagcagagcgagagttcgtctcaaaaaaaaaaaagaaagaaagaaagaaagaaagctatgccccttgaagaataatcaaagatccaaaagagttttgggctgggtattggagaagaggagagaaaggtggtgtagcagagtggtcagggccattgcctttgaaatatcagtggtgccatttacatagctgttggaccttgctaaaatcataagctcttcaagccttatttgcttcatctataaaataggaatcaatgataggaccttttcatagattgctttgtggagtaaatgtgttaaaccttataaacctggcaggtagctgcccagcatatagttgcgttatttactcaattcaaagtactttcctgccgggtgcggtggctcaggcctgtaatcccagcactttgggaggctgaggtgggtggatcacttgaggtcaggagttccagaccagcctgaccaacatggtgaaaccctgtctctactaaaaacacaaaaattagccgggcgtggtggcagtcacctgtaatcccagctacttgggaggctgaggcacaagaatcacttgaacctgggaggcagaggttgcaatgagctgagatcgtgccgctgcacgccatcctgggtgatagattgagactcagtctcaaaaaaaaggcaacaaagtactttcctttggaaaagagtgcccactggctgggtgaagtggctcacgcctgtaatctcagcacttgtggggctgaggcaggcagatcagttgaagccaggagtttgagaccagtttcacgtggccaacatggtgaaaccccgtctactaaaaatacaaaaataagccagatgtggtgtcatgtgcctgtagtcccagctactcaggagagtgagacaggagaatcatttgaaccctggagttggaggttgcagtgagcagagatcgtgccactgcactccagcctgggtgacagagtaaaactctgtctcaaaaaaaaaaaaaaaaaaagctctcactgattcctacagcttcagagaatgaacgaggaccaaaatgtggatgctacagggaggaaacttgaggctcaaaatggagatctttctataaaatacaattgttctaccacaggaaaagctgctttattaagtagtgagtattccgtcattggaagtattaagcccaagctaaatggtcaactgtcagggaaggatggtgagaggattccagtgggttagaggtcaaagagcgtctaccaggtgcaaaagtcttaattaacaaagtactatcaaaaccaaattcatgtttgggaaactgtatatccacatgcaaaagaatgaaatcagactctttccttacaccatatacgaaaattaactaaaaatgagtttgacggaaaagtataaaacctttggaataaaacataagggaaaagcttcatgatattagatttggtgatgatttcttggatatgacaccaaaagcacaggaaatttttaaaaattagataaattggactacatcaaaattagaaaaatttgtgcaccaaaggacacttgactgagtgaaaaagcaacttacagaatgggagaaaatatttgccaatcatatatctgataaggggttaatgtccgaaatatataaagaactcttacaactcaataacaacaaccaaaaactttaaaaatggacaaagaggccaggtgtagtggctcaagtctgtaatctcaccactttgtgaggcagaggcaggaggattgcttgagctcaggagtttaagaccagcctgggcaacatagtgaaactttgtctctacagaaaaatttaaaaattagccaggcatgctgcacacctgtagtcccagcttacttgggaggccgaggtgggaggaccacttgagtcaaggagtttgaggctgtggtgagccacgatcctgctgctgcactctagcctgggtgacagagcaagacctgtctcaagaaaacaaaaaaattggcaaaggacttgaataggcatttctccaaggaagatatacaaataaccattaagcacataaaaagatacttaacatcactaatcattagggaagtgcaaatcaaaactgcaataagaggctgggcacagtggctcatgcctgtaatcccagcactttgggaggccagggcaagtggatcacttgaggtcaggagtttgagaccagcctggccaacatggcaaaatcccaaatctactaaacaatataaaaattatctgggtgtgggccaggcacagtggctcacgcctgtaatcccagcactttgggaggccaaggcgggcggatcacgaggtcaggagttcaagaccagcctggccagcatggtgaaaccccatctctactaaaaatacaaaaattagccgggcatggtggcatgcatctgtaatcccagctactcaggaggctgaggtaggagaatcgcttgaacctgggaggcagaggttgcagtgagccaagatcgcgccactgcaccccagtctgtgccacacagtgagactctgtctcaaaaaaaaaaaaaaaaaaaaaggaaaagaaaaattatccgggtgtgatggcacatgcctgtaatctcagctacctgggaggctgaagcaggagaatcgcttgaaccctggaggagaagtttgcagtgagctgagactgcactactgcactccagcctgggcgacagagcaagactatgtctccaaaaaaaaccaagacaaacaaacaaacaaaacacacaataagagaccacctcacacccattaggatggatattataaaacaacaacaaaacagacaatagtaagtgttggtgaagatgtggagaaattgtaacccttttacgttcctatcactgctggtgggaacgtaaaatagtgcagcttctgtggcaagcagtatggcggcttcctaaaaaatgaaaaatagaactatcatatgatctagcaattgtactcccgagtatatacccaaaagaaccaaaagtagcatctggaagagagatttgtatactcaagttcatagcagcattattcataatagccaaaaggtacaggcaacccaagtgtcaatcaatggatgaatggatcaataaaatgtggtatatgcatacaatggaatattattcagccttaaaaaggatggaaattctgacacatgctacaacatggatggatcctgagggcattatgctaggggaaaagctagtcacaaagaacaaatactgtatgattccactagcctacaggaaagtagtcaaattcacagagacagaaagtagaaggggtttgccagggcctgggaagaaaggagaactattttcttttcttttcttttcttttttttttttttttgagacggggtctctctctgtggcccaggctggagtgcagtggtgcgatctcggctcactgcaacctccacttcccgggttcaagcgagtctcctgcctcagcctcctgagtacctgggattacaggcacgcaccaccacgcccggctaatttttttgtatttttagtatttattttgtatttttagtagagacgaggtttctccatgttagcctcccaaggggagctattttctaatgggtacagtttcagtgtgggaagatgaaaaaagttcaggtgatggatggtgctgatggttgtattacaatgtgaatatatttaatgtctctgaactgtacgtttaaaaatggtcggctgggcgtggtggctcacacctgtaatcccagcactttgggaggctgaggtggatggatcacctttggtcaggtgttcaagaccagcctgggcaacatagtgaaaccctgtctctactaaaaatacaaaaatcagctgggtgcggcggtgcatgcctgtaaccccagctactcgggaggctgaggcagaaaaatcacttgaacctgggaggtggaggttgtagtgagccgagatcacgccactgcactccagccgggcgacagagtaagactctgtttcaaaaaaaaaaaaaaatacatgcataaaagatgtttctaagagtgctaaaaaatgcctacaaattgataaggaaaggtaaataatacaatagataaatggtcaaaggatacaaacaagcacactcataatgtaggaagctcaaatggcaaaagagcctctccttctctagtaatagaggaaatgtaaatttgaaagtgaagcataattttacattcagtatcttacaaaatcaagtgctgatgaggttgtagagcaaccaaaactctgtaactattgttggaagtggaagttggcattcaagaatgagcaatttagcaacatctcttaaaagtgttgatatccactgtctaagatacagaaattccatctctgcatgttacctagagaaactctcatccacaggtataagaatagtctttggagcatcatctgagatagtgagccaagatcgtgcaactgcactccagcctgagtaacagagtgagactccatctcaaaacaaacaaataaacaaaacagaataaatatactcaggatatttacagacacttttattttattttttgttatttcaactttgttttttttacctgcctcccaggtttaagcgattctcatgcctcagcctcccaagtggctgggattacaggtgcccaccaccaggcctggttaatttttatattttcaatagagatagggtttcaccatgttgcccaggcttgtctcgaactcctgatctcaagtgatccacccgcctcggcctcccaaagtgcttggattacaggcatgagctaccgcgcccggctgcatgtgtttttaaacattgcctggcccgttatttcaacttttattttcgaatcaggaggtacacgtataggtttgttacaaaggtatattgcatgatgctggggtttccagtatgaatgaattcatcacccaggtaatgagcatggtacccaataggtagtttttcaacatttgccccctccctctctaacccctttggtttctccagtgcctattgttcccatctttatgtccatgtgtacccaaggtttagcccccacgtataggtgagaacatatgttatttgaatttctgtttctgcattagtttgcttcggataatggtttccagccatatccatgttgctgcagaggacatgatttcattcttttttatgactgtatagtacttcatggatacacagcattttatctattttatttcttttttattttattttttgatagagacagggtttcaccatgttgcccaggctggctcttgaactcctgggcttaagtgatctacttgcctcggcctcccaaagtgttggaattacaggtgagccactgcacccagcctacacagcattttaaatgagtggtctggtgcaacttgtatcatcatgaaaagatccagagacctattatgaggagtaataaaaggaagttgctgcaggatatgtacagtatatcatttaaataaattttccagataagcaaaatattttactttgcttatatagccacgtatggtagaactgtgaaaatgtgtctggtaatgacacattaccagataaataccaaatacacatgataaataccaaatggtgaccatgatcaccactgataagggtggcagggtgatgggatcaggaagacaaggggcttcaactctaagtgtaatgtttaatttgtcattaaaacaaacaaacaaacaaacaacatccaaagaaaacatggtcatgtagtaagatttgacaaaattgagaggtggatacataaatgttcataatattattctctatacttctctgcatatttgtaatatttcttactttaaaaaaaggagaaatgagattataaaaaaaagtcaaccatcttcctacataccagcgacagacaatttggtagtataattttaaaaatcatacaatttgcacaatgacaacaatttgcacaatgacaagcaaccgtggataaaaatctagaaatctatatatatatttttttctttgagacagagtctcagtctgttgcccaggctggagtgcagtggcatgatctcggctcactgcaacctctgcctcccgggttgaagcaattctcctgcctcagcctcctgagtagctaggattacaggtgcatgccaccatgcccggctaattaccatgcccggctaattttttttgtatttttagtagagacagagtttcatcatgttggtcaggctgatctcaaactcttaacctcgtgatccgcctgcctcaacctcccaaagtgctgggattacaggcatgagccaccatgcccggccctagaatcctattttttaaaagcaactaggagtatatctaagatatagcatttctctgtctgagagcagggagagcttgcataggtgtcaatgtccttcaagggactcttgaaactaattcagggccctatacactgcaggcatttcttggagtggccaaggtattgtcatgtgttaagaattctgagaagttctcggataatgaaatttgtgcagctttctttaattcagcagttttcaaacatctaacaatagaatccttcttgtctgaggggcctcgccttaggaaaggctgccctaacaacctcaaagttcccttccaacacccacagtccaccattctagtcttggctctgccactaacttactgtatgactttggccgaatcacctttcctcttggggtctcagtttgttaagttattaacaccctgggtgacagagcaagaccctgtctcaaaaaaaaaaaacaaaaacatttccctggcaaaaaatttatgactaaatcctccaaagcaatcgcaacaaaaccaaaaattgacaagtgacacctaattaaactaaagagcctctacacagcaaaagaaactatcaacagagtaaacaggcaacctacagaatgggagaaaatatttgcgaactctgaatccaacaaaggtctacaaggaacttagcaattctacaaggagctagaacctacaaggaacttaaacaattcaacaagcaaaaaacaaagaaccccaacaaaaagtggatagagcacatgaacagacacttctcaaaagaagatgtacaagcggccaacaaagatgaaaaaatgttcaacatcactaatcatcagagaaatgcaaatgaaatcgtgagataccatctcacactagtcaaaatgattattaagtttctttttttgtccccacccttgatatctgaagaatggctgtcattaaaaagtcaaaaaaataacagatgttggcaaggctgtggaaaaaagggaacacttatacactgttggtgggaatataaattagttcagccactgtggaaagctatttggagatttctcaaagaacttaaaacagaaccaccattcaatttagcaatttcatgatttggtatataaccaaaggaaaatgaattcttctaccaaaaagacacatgcacttatatgttctacacagcactattcacaatagaaagacatcagccaagcacagtggctcacgcctgtaatcctagcactttgggaggccgaggcgggcggatcacctgaggtcaggagttcgagaccaacctggctaacatggtaaaactgtgtctctactaaaaatacaaaaattagccaggcatggtggcacatgcctgtaatcccagctacttgggaggctgagacaggagaatggcttgaacctgggaggcagaggttgcagtgagctgagattgcgccactgcactccagcctgggtgacagagtgagactccatctcaaacaaaacaaaacagtagaaagacatggaatcaacctaagtgcccatcagcagtggaatggataatgaaaatgtggtacatatacactatggaatagtatgcagccataaaagggaacaaaacctcaaccaagttcaaggacagtgtcaaaaaaataaaaaagggaacaaagtcgtgtcctttgccacaccaggaatggagctggaggacctcatcctaagtgaatcaacacagaaacaaaaaaacaaatactgcatgttctcacttgtaaaaggaagctaaacattgggtacacgttgacatcaagagaggaacaatagacgctgcggacttctagaggaagggcaagggctaaaaaactctctgttgggtactatgctcactacttgggtgatgagctcaatcatagcctaaacttcagtgtcacacaatatacccatgtaacaaacctgtacatgtaccccctgaatctaaaataaaagtttaattaaggcctggtgcagtggctcacacctgtaatcccagcagtttgggaggctgaggtaggtggatcaccagaggtcaggagttcgagatcaggctggccaacatggtgaaaccccacctctactaaaaatacaaaaagaagccaggcatggtggtgcgtgcctgtagttccagctactcaggaggctgaggcaggagaattgcttgaacccaggaggcggaggttgcagtgagccgagatcatgccattattctagcctgggcaatggagcaagactgtctctgaaaaaactaaaaagtttaatttaaaaaaaaaagggtgtgtatagtttgatctcttaccttttcccagccataacacctcatgttggaccccacgtttaggggtttattaggggctttttaggggtttggttttatttctcctcccccagttaactgtttcttacttaactaaagcaggttcatggtagaggaattacaaaaatgcagagaaggatgattaaaaaagaattaaactaggctgggtgtggtggctaacacctgtaatcccagtgctttgggaggctgagttggaaggatcatttcaggctaggagtttgagaccagcctgggcaacacagtaagaccccatctctacagaaaattttaaaacttaaaaaaattaaaaagtaaacgttagacaggcatggtggtgtgtgtctgtagtcccagctacttgtgaggcttaggcgagaggatggcttgagcccaggaatttgaggctgtagtgggttttgactatgccactgcactccagcccgggtgacacagcaaaaccctatctcttaaaaacaaatcagatttactccaaatgccacttttggctctttatgatgacagctgacatttatagagcctttatgtgcaaagcgcagtggtaggatatctcgtttcacttctcgttgaagtggaagtcaagtctattcttatccttattttacagatgaggagactgaggatcagagagataaagtcacctgtccaaggtcatactgtggatgtagctctaacccaagccctcccgactgcagcacaaattctcagccactaccctattagccccttcatttgaaggtgtcttcatca

SEQ ID NO: 194321 - DNA, 486 bp, Homo sapiens
ggactgaaggacagagagaaattgcatgcctggagtctcactgctagtacatagaggtgttatcttcctttcatctaacatatttattgagcacctactatgtaccaggccttgtgctagactctggggatatggaaatgagcaaagtagatgtacccccgaaacttgtggactaatggaggagacggaccttaatcagatcgtcattcaaagatactattacaaactgttctgagagccgaggaagcaggaaggagctgtgagagactgagctctaaccttggccatcaaagacaagctgtgcagctctggttttttgagggcaggacatggagggtcaggcccagctggaggcgcaccaaagcccagagaaaattcagaaccacgtgaacttgttggatttcagccccttgaagcacatgttgctattgcagctgccttgataactggggggacaggaggagcacggctttcccatcttgtacg

SEQ ID NO: 194322 - DNA, 494 bp, Homo sapiens
gtggtgcgcgccgtggtgcgcgccgtggtggccgctgccgatgagcgcctccaccgcgtcctcgggcgtcaggttgagcgcctcggggttgaggtgatgctggtagccgctcatccagtacagatcctccagcgccggcttccccgaggtgcccccgacggcgccggggcccccgctcggcggcccgggggcgcccccggcctgagacgagccgccgccgttttccgcgccgccgccgccgccggtgcccgggctgggcgcgcagaagctgggcgaggagggcacggaggagcagggcgtgctgagcggcgtcgaggacagcgagcctggcggcaggcggtggcagaagcgctcggcctcgggaggctccttcttcacctcgaacttcatcaggtcgaagtcgttgacgtactcgatggccagcgggctgctgggcagctcggcgcccatcgccagctccgcgggcatcgcccggggcccgcgcccggccgcgc

SEQ ID NO: 194323 - DNA, 1992 bp, Homo sapiens
cggctcccggctccgggaaagaccttctgttctctgccggcgcggagggccgcaggaaccaggcctctcgcctccccaccagctaggcagggagcgcccatctcctgaaaaattacttcctgggaagcggtgcggggagacagcttcaattgctttcggttggtgaaaaacgaattcgcttctcagattgctctcctagctgccaggctctgacgttgagaggccggctttcagcctcgcgctggaccttccacaagtgtttgcacatgacctggaagacagtcagaggcagaagtccctgcaaatgctcctggctacttcctgcaggcagctcatgctgctgcagcagaagactttcctatgtctagctgccagtattctgggtgctgggggcatcctgttcctaggatcacagccatggtggtatgttctagaactcagaaatttaccaaatcactggatggaccagaggagtgagctccaggttgggtttccagaagggactcccagaactcttccaccatacaggcctctcagggagctgctccctctgccatggtcagtgagagggggaagcaggagccgccattggggttgttgagttcgtggctgcaacccagggatgaggaagctgctgctacacacccatgaagctgatgcctggacataaatccctactgataagtgtttacgacatttccagcgtggtgccgacactgcatggaaatgctgcatggaaagtccttatacatctatctttgtgcatttattgtgagcacctactatgagtaaaacctgggctggtggctggagaaacatgaagatgagtaagagccaattcctgttcttggggatttaataatatattcaagggaaaagacacaaaataaccatttccaggtaaactctggtggggagggtgggaggagaaccgtggtttgcttttgtgcccaacacttcacattccttacctctttctccccaccgagaccttgaggagcagcctgagccagaggaccagcatcctcatcttctctccacctcttactaggggggtggctttgggccagtttcttacattctttgggccactttagtttccttattgaaaaatggggataataatagtggctacatctcagtgtgattctgaggaaaccagaattgtacatgcagagcacatgcacagaacagtgcctggcacagtcagtaattgatcaatgtgcgctattgttgttgtgtatattagttctcccctgatacagatgagagctatctctaactcagagacttgccacatcattaaattaggagtgagaactgagcctggataaggaagaggaacaggaattcaacacagtgaacacagcaggaaaggcttgtgcgaaggctctgggctggagatgtgtaaagcatgtctggagatggggaaggtccattgggccaggaaaccacaggctctgctctcctggagcagaagcacagcgaaatcacagccgagcagaggagggcaagggagagggccgccccagtctgagagctgcagggtctggctggaactgctcccggccagcggacttcacccgggcgcgggggccgcacctgccgggcgcggcctgctctatggcgccctctgctgttagtccgccccaggctccgcgccggcctctcctgggtccgtggggcctgcgggctgcggggatcaccgagacccacattcccgtggccagcagcctttcgctctgctcagaggagaggcagaagggcatattgctgtttcccagtcgctttttacacctgccttcttcggataaacccaaaaatcttccttcagagaagacggcccgtatttcccgttatttgggggtggaggtggggctaagggcgtcatagggagagccttactttcaacattctgcattatgaaaccaagggagactttttttcccaacaagtgtgaacattttttttcaagagaattaaatcgtttat

SEQ ID NO: 194324 - DNA, 1767 bp, Homo sapiens
gggttgaactgcgggctggagaaggaaaaccctttgacaattttgagaattcagcatgttaaagtaacacaccattggaaggtggtcgctacagcaaatttggatgagatcattaattacaattttaatgagcagaaaacagaaataaacgcaataaatggctcaagaataaaatttgatcagcaccaccgacggatggagtttagctattggtgtcaaagcgctcatttgggtccaagcacgaaaagccaggagggcgtactccgcttcgataaccttcgtttactaagcactagtttttaagggtcagcttgagtttgagtctgaaactgggggaaggaagggttatatttgccagttttatttccttctaagatagaagcaatgttatttggtcctcctcttcctttatctttcttcattaacttcaagactggtttaaatctattatttcatggactttagaatctgacctggggtaaggtgaagtccttcgtcagcatgaatagtgctaaggagtcaagccaagacttgcttcagaagagagctgatgtgcggaccttctgcatttccacgcggggatccagtgcttgggtctaaaccccagcgccctgccacctcggccaggaagctgcgggaggatggtggcaggcatagcccgtcctagccttgaaactggggggcctatgtctctggcttcgttacaaacgaaacgtttctcgccttcggacactccaccctggcggtggtacccaaccttcagtctccactctgcgcctggccctccagcgacctcctcacatcctccaggacactgcattctcaaggactaggtaggaattgggaggaaaagaggccagtcatccccaaagattccaatgttaaagagtgatcccctttttatctcatgtaaatattatgactcggaagagagttgaatatttccctattgagaatgttagtatctactattggaggcggggttgccaaagagagacacgggggtgggggagagattgagactgagattcaactcaatccaactcagggtgaactgtcttgagtaaatagttgcaacgcttggtgtaaggatgtctccatcgttcacttttacgtatcatttgcattgccaaattaaaatggcagcattgttcttaattatgacaataaaaaattccggatccgtgtaccttgatccctggtagtgagggggtgagccccgggtgctcgatcccgcgtagagcagcgtgtattgcagacgcacgctgggcagcacgggaaggcaggccggtgcctcctgccaggtgctagttgtagtggatctgctgcctgtctacagctgggagcggtgacaacgatggagcgtcctcggagagggtgggctgccccctgtcactcccgggggaagatcgccctgccctccgctctaactgcgtggttgaaaccagtttcgggacccgagtcctggtcccgctgacgcgggaggcttgtttctggtggggcagtcttaacgcattgccttcagatgcctttgagagtcaggacttgctctttcttggggatcctccgaaaccagcatgccttcctgcccacgacctaataaagtgggactttttcaagtaccccttgggagtggacgtgtaacacgtggtcgcaaggatcccggcgcatctctacgcagtatatctaatggggatgggggggctctgtttgaaagcaaatgatttgcattttaattgaaaaataaatgaaagcggtttggcaaat

SEQ ID NO: 194325 - DNA, 1240 bp, Homo sapiens
tgccaggcggcgagaacgcgctgggggaacccttggtccgctctgcgcgtcgctctaggatccccgaaaaggagcacgggcgcgaaagcggccaggctgggccaggatctagaaagactgcctggcgcaggctccctgcccccgcgggcctgctgtcatggactcgtggagagctcgcttcccgcgcggacccttcctgcaggggtccacgtccaggcaccggcggctcggacaccccacccccggccgggcacctgccctgggtgccccttaacccgggcggtagctcgttaagatggcgaagtgtccggtccggaacacgcgaaaccccaaatcccgcctgcccgacctcctgacccccggccccacgggacgacagactgggcctcccgacgcgcagcgcgctgccgggacaccgggtgcgtgcgaaacggcaggaccctttgtaacgccacgtgtcttgctctttcttgacaaaaccagaataaatgcgctcaactggcctgaaaaaggtctgcccgcctaataaaaaaaaaaaaacgggcgcgtcggctcctagcagcatccccccccagggggccccaagcgtttaggcggtaacccccggtttttgctttgttacaaaaccgagggtcccccttataagggcgagggtcgcgacattcacatacacgcccggccggctaccttgggttccgcgtcgcccctgttccaccagagcgcgcccatgtgtgatacttggggcgagacaacaaacacgtgtgattacaggactctgggggggcgaacacctcaccctcgcttgagaataacgggaatacccccccttcacgttattccctacgggggggggggggggcggcggaaaacaattacgtctgtcggtgggacaccgcgcacatgtacacgacctggagagcgggaaggtaatattgtctaaaataaagccgcgccctttagcggcgcgcgcacgaacatatgtcatacaccaatgtcccttgtctcacacacccggaacacgacagcaaaggcgggggcggtccaaacaggatcgaggccacgcgctctgcttaacgaggcactcgctggcgctgcaccctccttcgacgctgagaatctatttcgtgcgcgtcatcctgtgaacaagccgactagggaggatatgttcccggccaacacccgcggtcatcctctccgcgcgcacagtgcgcgcgcgcgctcctcggagtgccccgctaat

SEQ ID NO: 194326 - DNA, 3016 bp, Homo sapiens
  ref <308>: DATABASE ACCESSION NUMBER: NM_004860.3
  ref <309>: DATABASE ENTRY DATE: 2010-12-27
  ref <313>: RELEVANT RESIDUES: (1)..(3016)
gcagtaggcggcggtggcagggggaggtggaggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaagggctttgtgaaggatgtccatgaagactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggcaaagtgattggaaagaacgggaaagtgatccaggagattgtggataaatctggtgtggtgagggttcgagtggaaggtgataatgacaagaagaaccccagggaggagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggcaaaaaaaaaaaaaaaaaaaaaaaaaaaaa

SEQ ID NO: 194327 - DNA, 1609 bp, Homo sapiens
cagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggtaacccgggggtcagagtggcgcggccagagcggggtcgtaggaggcgggggcagggggaggggctcgccttgggaacctgctcggggagcagcggggcccttctgctctaatctagcttccgtacccacgccttaggagctagccgaattcgaaaaactctcggatcaggtgaagatcagtgaagaaggtgggggctcagcgcccaggttctggcggaggctggggaggaaatgagggatgggttccccaggcgacagctccaggctgggcatacacccacgtcctctttctctatctctttgtcacaactccaatctcggcagccctgagagcagatggctttggagacaatcctttctatcactgtttggtagcagagattcttccagcgcccgggaagctactgggtaagagcacctggcccttagaagtccacctctccagccggcctcagaggtctccccacaggcttccagaagccttactccccttttctctctctcagggccctgcgtggtgggctatgggatatactatttcatctacagtacatggaagggacgcaccatttatctggaggatatctatgtgatgccggaatatcggggtactgggcagaagctgaggctggggtgggagcaaagcaccccacagaccccactgttatcccctgtccccagagcccagccggtgtcattttctgatccccttcagctcaaacaatagctattttttgcctctttctctccacaacaggtcaagggattggttccaaaataatcaaaaaggtggctgaggtgaggagatgggtggggcgacaagtgaggacctgaagaagcaagggtatatggaggggggacccgggttgaaagagggagtgagaaaacctttttcttttttgaccccagaaaagttagtgttgtcttctcccacaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtc

SEQ ID NO: 194328 - DNA, 312 bp, Homo sapiens
tttttttttttttttttttttttttttttttttttttttttggtgggtggtgatggtggtggtggttgtttctgctaacacttttaaaggataaagacagcactttggtctctttcttctattttctgagatccaaaatgagtctgtatcagatatactttacagcaagcatttgctaacttaagaaggttacatttataagacagggcatttgaaaacactcaccgatttcctggcaaaacgtgttggcaggttggggtcttttttgtattgccagttggcaggaaatctctttttggcctttccaaatat

SEQ ID NO: 194329 - DNA, 243 bp, Homo sapiens
  misc_feature (228)..(228): n is a, c, g, or t
cagagacccatggaaacaaacagctcacccagcttcctcttgggcttctcactccaggtggctggggcaagcagggaaatgaagatactcaccatagcaactacactgggacctatagaacagggcctgaccttattcctgtttccctccagcttgcccacgaggctcagtgaagaaaaaaaaaagaaagaaaaggagaaaaaaaaaaaaaaaaaaaaaaaaaaaaanaaaaaaaaaaaaaaa

SEQ ID NO: 194330 - DNA, 802 bp, Homo sapiens
tggcgtttagggaccaggacactaaaggccccggcggggcgggagcacccagcgtgacctcacgctcctacacacagacaagcaaacgggccggcccccgcacgtgacaaggcagagccgggcccaggccagctgcctgtccagccctgggatgagaaaaggcgtcaggagatggaccgggcctggttcgcctttaattggctgacccgtcctgtgggggtaactgacgcgtgaacagccaacaattgggccctctggccgggacaaacacgtgcgtttggggagtagaagaaggctggtattaacctccattttacaatgaggaaacggagtcccaaagacgttcagtcatcttcctgatattcacacacttacaccctggtcaggccggcgccatatgtgttttcaccagcagaagggactgccagggaacagctgaggggaccagagctgggatgggcctggataattatagcggaaagaaaaacacgccgagcgcatggtcctggcagaagcagcgtggaaacagaagtcaaggcagattatttctgccatgaggagatcttgccatgtaggaaaaaagaaagaaagagaggaaagaaagacagagagagagagaggaaagacagaaagacaagaaagaaagagaaagaaagaaaagaaaaaaaaaaagaaaagataaagtttttttgtggcactgtgagtctccctccgccaggttctctagcttttgcgctgagctctgtctggctgtgcattccggagaggctcggcaaatttgctgtgagattgctgagcaaca

SEQ ID NO: 194331 - DNA, 514 bp, Homo sapiens
  misc_feature (501)..(501): n is a, c, g, or t
aaagtatagtcatttatttctcctagtaaatgttcccttgttataatgaacaatggtttcattgttcatgatttactagaaaggcaacaaatttgaaactggttataaacatataatctgtttctaaccatatcatttttaagcagttctaaaaactcagtaaacagtaaacattttctcttcttttcagaaataaaatctcagagcaaggtgtataacacttgcatttcaatacatatttatgttccatacttacagcatgcattttcctacatatcaaaggacatttcactatcattgaactcatttcatcttttgccacacacagcattccacaatcccacagccctgaagcttggagaacatgtctctcacattcaaaatctaactaaactaacagtttaacagcttgtctatgtaaaatagggataggaacattgccaagccgaaataacagttgcctcacaaatgaaatgtccaagctcgtaaagtcacaaactntgacctttaggct

SEQ ID NO: 194332 - DNA, 936 bp, Homo sapiens
  misc_feature (17)..(17): n is a, c, g, or t
  misc_feature (20)..(20): n is a, c, g, or t
  misc_feature (24)..(24): n is a, c, g, or t
  misc_feature (748)..(748): n is a, c, g, or t
  misc_feature (898)..(898): n is a, c, g, or t
  misc_feature (918)..(918): n is a, c, g, or t
aaaagaaaacaatgaanagngtantagggaacagaatatgatatggaatggaaagtaagaatttacaaacagagatggaactggctgtagcacataaagtcaaggatttcaaattcactaacaacagaaaacaaatccttctctgtgacaattagctaacagtagcctttactttttatgtgataaatatcaacctaatattaaatgaatatttatggaggaaatatttttaaaaatatttggttaataacaaataggtaagatatcttagtataaaacttggacagcattccagtagtccccctccccaaatactccaaaatcctaataattttctaacagagtttcatccatgtttcacttagatttttggaaatttagagtttctgacagaactgaaaaatccggctattcagtagccagataactaagaaaaatgaaaccacatacaatgctgaaatggttactcttccatcttgtcagccattcagttttccactgcaaaagtaaggacaatgcccttttatgctgtgagaagagctgaaaacatagacatggacttaaggtgcctgccttcaagacagtttggtggtctccattgctttgatctcttcagatcctattctgaatggtactcagttccagcctacgtgtcacatttgattctaggcacattttcaccaaaatgtgcatggggtcaagcttccagtgatcccttcttatattgtattatcttctgggtccatanacccttgtcacaccacttcatgatagtttggacagaatttctgtggaagcaggtgctggttgaatagaattaacattgctaatgaaaggctaagcttcattcaactcctttcaggtgccacacagtagtagattttgaggtatgtgagcncaagacagtaggtaagtaancctctctttcactttccc

SEQ ID NO: 194333 - DNA, 1075 bp, Homo sapiens
  misc_feature (443)..(443): n is a, c, g, or t
  misc_feature (453)..(454): n is a, c, g, or t
  misc_feature (939)..(939): n is a, c, g, or t
  misc_feature (993)..(993): n is a, c, g, or t
  misc_feature (1012)..(1013): n is a, c, g, or t
  misc_feature (1017)..(1017): n is a, c, g, or t
  misc_feature (1020)..(1021): n is a, c, g, or t
  misc_feature (1027)..(1027): n is a, c, g, or t
  misc_feature (1039)..(1039): n is a, c, g, or t
  misc_feature (1043)..(1043): n is a, c, g, or t
  misc_feature (1052)..(1052): n is a, c, g, or t
  misc_feature (1058)..(1058): n is a, c, g, or t
  misc_feature (1067)..(1067): n is a, c, g, or t
cagacactgttcacaatagtcccatataataggtacttttattataaaatattgcaaatacaaatatgagtcctaagtgggtttggtaacttgcccaaggtacttaaaagtgatgggtctggcattcttaggaagtctggattgaagttcttaaccactacgctcttggtagttaagatttttctaaaatagtatactaactgtgtctgtgtatactcaatcatataggcacctctacatttttatgtttgcatatttgataaacttaaaaatatgtaaaatattattttgtaagcatgttaaaaaaaagaataaaaacctttacatgttttgtaaaagaattttacagtgtgaaaatgatttatacagtctctgcagttatataaataataagaactcaaatcttctaaagataaatattatcaccctttcaccagggaganaatgtaaacnnatcctggctataaatattagttagaaaaatgacactgtaaaaatctttattaaaattaatttgtggtatacattgaaataaaatgatttatctgcaatagtatttaatcaaatactagtaaccccctcaagtctttcaacagcacattacttttagtttaaaaatattagttgaaaaaattttttgaaaacttgtaaattattagagtcctggctcccttggtttgtgattataaatgaaatcacagtgccttgagatactatagggcatttcactcttaaccatgcatatgtgctagatagagctgctgtgatttttaaaaatctggaaatctgtagaggaagcaaaataacttgttttagaaggcagataattgcctttttccttcttcctacaccattatatattctatgagcctccattagtcttaaccatagagacttaacaaaaacatagtgctataaaactgtacttagaaaaataanaatcttttaataatttttaaatatttttgtatggcattctctggaaaagtaggngtggttcttttagtattannttgngcnntgccanccttatatgggnaagngaggacatngggaanaattaattngacgggct

SEQ ID NO: 194334 - DNA, 823 bp, Homo sapiens
aattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagctagaagccacagctgccctccacagagcggcactgcacgatgcgcaggaatgtctcgaccttgtccatgtccttcctgaagcagtagagcagcccgtagttcttgagtagtgcgtcatcgttgtgtgagtttgtgtcgaacttgctgtaggtctgcttgaagatctgcccagtccgggggctgccatcttcca

SEQ ID NO: 194335 - DNA, 979 bp, Homo sapiens
ttataaaagtgttcattttaatgagataactgtcatattaaagccttaatatttcagggtgacaagaaagtctggaaacataggcaaatattttccattttgacagtgttaagtgaccaacttgaatgccagcacttgatgagtggagggaaagtaaccgggagtgattccaacaagatggcacaccacccccttacaccacattggtgaagaaagctggatgaagatttccaaagaaagcggccctgtggagtgggcttcaggcttgccagatctggactcccttgatagcttcttctggagtgcacttaaaacacagatttattccgtgaaaatcaagcagcatcacagatgcacatgcagggactgacagaaatgctgcattcatgtaccacattcacggaaattttgcactatttattgctcatgagggccgacatcaatcatgtgatagcaagaaatcatttgttcatgtagattcacctagtttgcagaagtttgtggttatcttatcatttgacacagtgaagccaccatatattctgagagctggtcacattaaagtacttccaccaacctgaggttggcactgcaaacactgaatgagcacagcattcctccttgaacccaacgggctctgctgtatctgtggtttaccaaaaggcaaaaagctgggtcccacctgaggttggcactgcaaacactgaatgagcacagcgttccctcttgaacccaagaggctctgctgtctgtgtggtttaccaaaaggcaaaaagctgggtctcagtcaactgctgaatgcattagagtacagaggctgtagtcctcaggcctccccctcactgcaagggtaacacaggaaagataacctcccatctttgacacgccagcggggaggaggggaaagaacctacacaagttgaggagccctttttcagttaagcaagtcagtggccttacgcaccatccaaaaccacac

SEQ ID NO: 194336 - DNA, 810 bp, Homo sapiens
atggagagcaggcaacagctcctccaactggttggagcagatatcactggaagccccccaagtattaagatttttaaacaacttcaagttctggtgggcacagccaaatacactgcagaaactttgggaccagcagccacgacacaacagagcggctgcgctaccgtgggcctgcgccgtggagactgcgaccgcgccggctcctcgcagcctcctgccaccagcggcaatggcgagcgctgccgcttctgccgccgccgccgccgccgaggagggggaggggagggagagggcacgcacgcgacgcacggcccggcttccccgcccggccgccgccatgatgaggaggtcggcgcggctgtgctgcgggcaggcagcggagagggctcgcggcgagggctccagcttaccccgccgccgcgtcgcgtgcacggagcgcttcagaggtttggagggggccggaacctcaaaagcaactggatgagcacaacgcggacgccccggagaagcggcgcaagcgggcccaaaatggttgctgatcagacgagtggcatctctcgcccccctaccgcgggaattgggacctccagactgtgcctgggggatcggcaagtggttcccctctggttttttcggcgctgccttcccggtggttggagatggctggaagaaatgaaaagaagaacgccaacaaaggcgataaagaaaaattcaacactgcttgataactgatgagatagtgaaggagtaggagggcaaaagtcagaagtaattccaggtgttcaagaactaaatgctgaagagatgtta

SEQ ID NO: 194337 - DNA, 288 bp, Homo sapiens
  misc_feature (6)..(6): n is a, c, g, or t
cctagnatatacgggtcttgctgtgttgccctgactggtctcaaactgctggactcaagctatcctcccgacccggcttcccaaagtgttgggattacaggcatgagccaccacactcatctatttttttaaaaaatttaaaaggtttatagcctaacgtatttaaataataccatttaaacgtatgtcatgatttcaatagttgttatttaaaaatcctaaagttactaagctaagaggaacagaaattaaatggcaacaaattttaaataagtaaaaaaaaaaaaa

SEQ ID NO: 194338 - DNA, 437 bp, Homo sapiens
ttttttttattttttttaggtgtctggagacagagaaaggtttattccatttggccaaagcaagaagacaagacagcaagatttctcaaatccccttgacaaagagataaggagagggtttttatgcagctgacgagtcagggaaggggagttttggggaatggagggaaagtccgtgtgtcttccgtgtcagctaacactttgagcagccagacctccgggtgtcagcacctggtcgcagcactttcaaggcattcactccgtctgcaaacatttctcatgaccctcatgttatctcctcccgtttgacaaagaaacagtagatcagcagtttataatgatgctccttctctggctaatctgtcagcttcttcattgcctataaatcccgaatgaccaggaacatgcatccactgaatgtccatcccctgggtaag

SEQ ID NO: 194339 - DNA, 278 bp, Homo sapiens
ggatgtagaaatccctcaaacacactgctgtgttctatgctagtgacactctcgatcgtagaattgtattacttgtggttgcagcgagccgagattgcgccactagcctggggtgacagagtgagacctgtctcaaaaaccaaaccaaaaaactgtattacttgtatgataaggaaaataatcaaatttgtgtatgtgggtgggtttgtttagtttttctgagacagggtcccactcatgtcgcccaggaaaaaaaaaaaaaaaaaaaaaattttggg

SEQ ID NO: 194340 - DNA, 436 bp, Homo sapiens
aatttgcacagtttttaacgaaagagccaaataaatttttgaaagtttatttatgcttcttggtctttatgagtcgcagctgttcctagagaatggcctagcagccagggtcgccgcacgaggctttgcgctatactaactgcccagcaagcaggcacatggggctgagacccagcacacatcctgcccactgagctgtccgcccaggccctgggcagcatgttcctttaatgtacccatgggcacaagtcacctatacaagcaggagactcaaacctgtcaactggacggtaaatggatgctttcagaatacttccagacttctgagttgcatcttttaaccaatggttttttgatttcttatcaaaatataagccacagcattttaggccatttgccttgcttgcctgcaataaaacaagcaaggacagtattg

SEQ ID NO: 194341 - DNA, 1140 bp, Homo sapiens
agcggggctgaagccctgggcccggcagaggaaggtcgagatggaccatgttgggccccttctctccccgcccccaggccgcagttcgggggccacgccccggcgtgctcgggtcaccgcgggaagcccttgaaccccctggcgcccggcacccacgtgcggtaaccgcggctcctcgagagctccagggatgcggatctacagtaagggctgtggccagatgaatgaatgcacattttttagtgggcagaaagatgttagaattcatgaattagaataagcacaaaggagggtgagaggggaggccgtggaagccgcattcctccccttgacttgggcgcccacccccgaaggggcgcgtcccctccctgctccactgcacgtgggtgtttaaccaggggatatccagtgcctcaagcaccacgacccgggagaaaactgggttgagaaggtcttctaacaagccttttgcacacctgccatgtattttgtcaggccttggggatgaaggtgagaaattcgagaatccccggagataacacatcagcaaatagtgcgcaggcagaacaagctgttggaggtgagagacacagagcagagaagcacccgcacctggagagtcaggagggcctcacatcagaacgcctgagcaaatacagttttgaaggatactaattttttaaaaagttcattcacatgagttagacaaagagaaagaagcaggacattctaggaagaaggaacggcccaggcaaaagcgacgcgtacattggcgtgggtccattcaagaattgtgcccacaatataccaggcacttgtccagacctgcatcgtccaatgcccacctcgacctcccaaagtgttgggattagaggcgtgagccaccgcgccctgcctgcatgtggctattgagatgtgctgtatgatacacaccagactttgaagactcagtgtggaaaataaaaagaattttaagaggggtgggggtcgaggggaggcagagcagtaggacaaatagctaatgcacgcagggcttaaaacctagacaacaggttgatgggtgcagcaaaccaccatgacacatgtttatctatatagcacctacatgttctgcacttgtatcctggaacttaaaattag

SEQ ID NO: 194342 - DNA, 2082 bp, Homo sapiens
gctccacggtggggatgccctccatgatgcggtagtcggccaggtaaatgttccccttctggaggggagccgcgatgggtggcaagtaggcacccacacgggaagcccgtgacccgcgccgcaggtgcacagggcgctggcgactaggggcaggggtgggacggggacagggacgcggggtgcgggcttgcctgggactggcgcgggcgccggaggtggggagagacggggatgcccgcgagggaggccgggaggagggccggggtctccgccggagcgggcctcacctccagctccgcttgcaagcacgttccctcgcccaggaacggagccaccatgtcgtctgtgacggggaacttgtctgggatccgcgtgcagcggcggatcaggccggggttgacgccgttgaggtactggtacccaaagaaggtgtcctctgcccagtgctcggccacgtactctgcgaggacggcgcgagggcgtcacaaggaggcccggcccccctcggggacggagaggcatgggacagaagaagactatgggcaccgagaggagtcggggaggaaaacgaggcccccagcctggcgctgagcggccggaggagcccggtgcgacattttccaagaagccgccagagggcgcgcgcgcgcctcgctgcctctcccgtcccactgccccgaagtcgggggcctgcctagcacgccggagaccgcctggctccccctgctcgatccgggacgccccattccataccggagacgacagatttcttgccagggaaaattttcctaatgtccttcagcctcttccacgaatgtttgcagtccaacaggccgcggactttgaaagccagtgccctaggagatgggattccaggaagaggccttcagaggggctgccaagcgccggctggggcaggtggcggggccgccccatccacttaggtctctgggtctcagggtctgtgcgtcgcaaagtctctgggtcccatgtctcaagatctttgcatctctaggtctctgggatcatgtctcaggttttctgggtctgcgtttcagctccctctgccttcctggccattccaacctctggggctgtcttggaggccgccaaggttgggggagagggaaagttcttgcaggagccctcgttctcccgtcactcacacggactcacatgggccccaggcggacgaagaaggaggccgtcttgaggaaggagtagcggagatttaagttcaggaacttggtggccttaaagttgatgagaattgggaatcccggaatatagccattccacctgtggggagaagcgcagggcaactgggatccagggggcggggaggaggcaggcgcccaggggaaaaccatgggcggggcccagcacagcttcgggtccttactcaggccggttggggttgcgatgcctccgcaccggagggcggtaactgggaatgtgcacatagctgggcaggccaggaagaaagactcgccagctgcaagggaaaccgagatgtcaccctcatgcccgtgcaccaccccagggcaaagggccagagccatcactgccccccacctccctggacccctgccgggcgcccagactctgccacccgccccctcactggtagaagtcctgcttggctctgatctcctcttttctgtgctccaggaggacggggagcgagtcatctgctgttgtctttcctgtagggagaccaaggagaggactcaagggctgacccttgcccctgcccacttcaggaagcaggagttcagcttctgtgccccaggtcgtctctgggggggcccatgaccaaggagtgggaaggctcaccttgggagagtgaaggtgcgtcctgtccggaaatatcagataaaagaatcacggacccaccctctttcctcttgctctactgtcaagctaagctctgctgctgcaaaaagtccctcctctagacccactgaaatattttttatttctataaattcatggagtacaagagcaatgttgttacatgcatagtggccaagttagggctttaggttacccatcacccaaataaagtatattgtacccatt

SEQ ID NO: 194343 - DNA, 380 bp, Homo sapiens
cagatctcagccagacagcagggactcaccccacctaccgtcccctttgtgcctgggtgtggtgggtactcgttttatggggagtggccaggactcttgccagggggagagtggcggtggaggatgtacccatgccatctgccctgccgcagcgtttcctccctgttcccctgcatgtcttccctccctcgggggaaacgcaggattctgttccccaagcgccctctacacgccccatatataccaagcatggttctgcagtgagcctatggggtctctggaaatgagttcccgggataagttccagaaagttgctcagctctcctaacccctgcacaccctggagccccctgcataccctgactcctggcgcacctggg

SEQ ID NO: 194344 - DNA, 742 bp, Homo sapiens
attctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaa

SEQ ID NO: 194345 - DNA, 4246 bp, Homo sapiens
gaaagtccctgactggagttggcagccaagccaggccctggagtgggcacccagagggaagacaggttggctaatttcctggagcccctaagggtgcaagggggaagaacacccacccgcaaagccccgtagggctggaccctacgttagcctgccctgctcggggttggcgatgctggaggtgggccttggaccagagaaaatgctttaattaggtgacaagcgggcagaggcctttgtctctggcgccggcagccacggcccccgctgacggcgtgggaaacagaccctgttccactccggtctccagccttggaatggttgccttcgtgcagtgcaggaggacgcggcagagggcggacgatcgctccactcgccgggaccaggtgcgggggccctgcccagccgctggggcgtggccaggctcgaagcacccaggtgtcgggggccgactctaagccctggcaccggaagagagagggcggcggattggacctcccggctccagcattgcaactgggcgctccgtctcctggtccacgcaatgatgctgcggctgctcagaagccaggtagcctgccctgggtgaagccttcgcgcaggtcaatgacggggcggaggggcagggcgcggtcccctgcatccccgatctggggagcggtgggcccaggggccatcgccttagcccctggcgctggggctcggcgccaagtgacgggcggggctccaccttccagccatccgcccggcccgggagggcggacgctgcgagactcccggccgcgccctctccttcctctcctccccaagccctcgctgccagtccggacaggctgcgcggaggggagggctgccgggccggatagccggacgcctggcgttccaggggcggccggatgtggcctgcctttgcggagggtgcgctccggccacgaaaagcggactgtggatctgccacctgcaagcagctcggccatgtggctccggagccatcgtcagctctgcctggccttcctgctagtctgtgtcctctctgtaatcttcttcctccatatccatcaagacagctttccacatggcctaggcctgtcgatcctgtgtccagaccgccgcctggtgacacccccagtggccatcttctgcctgccgggtactgcgatgggccccaacgcctcctcttcctgtccccagcaccctgcttccctctccggcacctggactgtctaccccaatggccggtttggtaatcagatgggacagtatgccacgctgctggctctggcccagctcaacggccgccgggcctttatcctgcctgccatgcatgccgccctggccccggtattccgcatcaccctgcccgtgctggccccagaagtggacagccgcacgccgtggcgggagctgcagcttcacgactggatgtcggaggagtacgcggacttgagagatcctttcctgaagctctctggcttcccctgctcttggactttcttccaccatctccgggaacagatccgcagagagttcaccctgcacgaccaccttcgggaagaggcgcagagtgtgctgggtcagctccgcctgggccgcacaggggaccgcccgcgcacctttgtcggcgtccacgtgcgccgtggggactatctgcaggttatgcctcagcgctggaagggtgtggtgggcgacagcgcctacctccggcaggccatggactggttccgggcacggcacgaagcccccgttttcgtggtcaccagcaacggcatggagtggtgtaaagaaaacatcgacacctcccagggcgatgtgacgtttgctggcgatggacaggaggctacaccgtggaaagactttgccctgctcacacagtgcaaccacaccattatgaccattggcaccttcggcttctgggctgcctacctggctggcggagacactgtctacctggccaacttcaccctgccagactctgagttcctgaagatctttaagccggaggcggccttcctgcccgagtgggtgggcattaatgcagacttgtctccactctggacattggctaagccttgagagccagggagactttctgaagtagcctgatctttctagagccagcagtacgtggcttcagaggcctggcatcttctggagaagcttgtggtgttcctgaagcaaatgggtgcccgtatccagagtgattctagttgggagagttggagagaagggggacgtttctggaactgtctgaatattctagaactagcaaaacatcttttcctgatggctggcaggcagttctagaagccacagtgcccacctgctcttcccagcccatatctacagtacttccagatggctgcccccaggaatggggaactctccctctggtctactctagaagaggggttacttctcccctgggtcctccaaagactgaaggagcatatgattgctccagagcaagcattcaccaagtccccttctgtgtttctggagtgattctagagggagacttgttctagagaggaccaggtttgatgcctgtgaagaaccctgcagggcccttatggacaggatggggttctggaaatccagataactaaggtgaagaatctttttagttttttttttttttttttggagacagggtctcgctctgttgcccaggctggagtgcagtggcgtgatcttggctcactgcaacttccgcctcctgtgttcaagcgattctcctgtctcagcctcctgagtagatgggactacaggcacaggccattatgcctggctaatttttgtatttttagtagagacagggtttcaccatgttggccaggatggtctcgatctcctgaccttgtcatccacctgtcttggcctcccaaagtgctgggattactggcatgagccactgtgcccagcccggatattttttttttaattatttatttatttatttatttattgagacggagtcttgctctgtagcccaggccagagtgcagtggcgcgatctcagctcactgcaagctctgcctcccgggttcatgccattctgcctcagcctcctgagtagctgggactacaggcgcccgccaccacgcccggctaattttttttgtatttttagtagagacggggtttcatcgtgttaaccaggatggtctcgatctcctgacctcgtgatctgcccacctcggcctcccacagtgctgggattaccggcgtgagccaccatgcctggcccggataattttttttaatttttgtagagacgaggtcttgtgatattgcccaggctgttcttcaactcctgggctcaagcagtcctcccaccttggcctcccagaatgctgggtttatagatgtgagccagcacaccgggccaagtgaagaatctaatgaatgtgcaacctaattgtagcatctaatgaatgttccaccattgctggaaaaattgagatggaaaacaaaccatctctagttggccagcgtcttgctctgttcacagtctctggaaaagctggggtagttggtgagcagagcgggactctgtccaacaagccccacagcccctcaaagacttttttttgtttgttttgagcagacaggctaaaatgtgaacgtggggtgagggatcactgccaaaatggtacagcttctggagcagaactttccagggatccagggacacttttttttaaagctcataaactgccaagagctccatatattgggtgtgagttcaggttgcctctcacaatgaaggaagttggtctttgtctgcaggtgggctgctgagggtctgggatctgttttctggaagtgtgcaggtataaacacaccctctgtgcttgtgacaaactggcaggtaccgtgctcattgctaaccactgtctgtccctgaactcccagaaccactacatctggctttgggcaggtctgagataaaacgatctaaaggtaggcagaccctggacccagcctcagatccaggcaggagcacgaggtctggccaaggtggacggggttgtcgagatctcaggagccccttgctgttttttggagggtgaaagaagaaaccttaaacatagtcagctctgatcacatcccctgtctactcatccagaccccatgcctgtaggcttatcagggagttacagttacaattgttacagtactgttcccaactcagctgccacgggtgagagagcaggaggtatgaattaaaagtctacagcactaa
